US009457096B2

(12) United States Patent
Klatzmann et al.

(10) Patent No.: US 9,457,096 B2
(45) Date of Patent: Oct. 4, 2016

(54) PROTOZOAN VARIANT-SPECIFIC SURFACE PROTEINS (VSP) AS CARRIERS FOR ORAL DRUG DELIVERY

(71) Applicants: CONSEJO NACIONAL DE INVESTIGACIONES CIENTIFICAS Y TECNICAS (CONICET), Buenos Aires (AR); INSERM (INSTITUT NATIONAL DE LA SANTE ET DE LA RECHERCHE MEDICALE), Paris (FR)

(72) Inventors: David Klatzmann, Paris (FR); Eliane Piaggio, Paris (FR); Hugo Lujan, Cordoba (AR)

(73) Assignees: CONSEJO NACIONAL DE INVESTIGACIONES CIENTIFICAS Y TECNICAS (CONCET) (AR); UNIVERSIDAD CATOLICA DE CORDOBA (AR); ASSISTANCE PUBUQUE HOPITAUX DE PARIS (FR); UNIVERSITE PIERRE ET MARIE CURIE (PARIS 8) (FR)

( * ) Notice: Subject to any disclaimer, the term of this patent is extended or adjusted under 35 U.S.C. 154(b) by 0 days.

(21) Appl. No.: 13/843,766

(22) Filed: Mar. 15, 2013

(65) Prior Publication Data
US 2014/0011739 A1 Jan. 9, 2014

Related U.S. Application Data

(60) Provisional application No. 61/668,865, filed on Jul. 6, 2012.

(51) Int. Cl.
| | | |
|---|---|---|
| C12Q 1/00 | (2006.01) |
| A61K 38/28 | (2006.01) |
| C07K 14/62 | (2006.01) |
| A61K 38/00 | (2006.01) |
| A01N 25/00 | (2006.01) |
| C07K 14/605 | (2006.01) |
| A61K 38/27 | (2006.01) |
| A61K 38/26 | (2006.01) |
| A61P 5/06 | (2006.01) |
| A61P 3/10 | (2006.01) |
| A61P 7/12 | (2006.01) |
| A61K 45/00 | (2006.01) |
| A61K 47/00 | (2006.01) |
| A61K 39/00 | (2006.01) |
| A61K 47/42 | (2006.01) |
| C07K 14/44 | (2006.01) |
| A61K 47/48 | (2006.01) |
| A61K 39/39 | (2006.01) |
| A61Q 19/00 | (2006.01) |

(52) U.S. Cl.
CPC ............... *A61K 47/42* (2013.01); *A61K 38/27* (2013.01); *A61K 38/28* (2013.01); *A61K 47/48246* (2013.01); *C07K 14/44* (2013.01); *A61K 38/00* (2013.01); *A61K 38/26* (2013.01); *A61K 39/39* (2013.01); *A61Q 19/00* (2013.01); *C07K 2319/02* (2013.01); *C07K 2319/21* (2013.01)

(58) Field of Classification Search
CPC ...... A61K 38/28; A61K 38/00; A61K 38/27; A61K 38/26; A61K 39/39; A61Q 19/00; C07K 14/44
See application file for complete search history.

(56) References Cited

U.S. PATENT DOCUMENTS

| | | | |
|---|---|---|---|
| 4,342,832 A | 8/1982 | Goeddel et al. |
| 5,547,929 A | 8/1996 | Anderson et al. |
| 5,633,352 A | 5/1997 | Dalbøge et al. |
| 6,890,518 B2 | 5/2005 | Patton et al. |
| 7,049,286 B2 | 5/2006 | Tchelingerian |
| 7,470,663 B2 | 12/2008 | Ekwuribe et al. |
| 2008/0139784 A1 | 6/2008 | Hazra et al. |
| 2009/0036353 A1 | 2/2009 | Behrens et al. |
| 2009/0239785 A1 | 9/2009 | Hubalek et al. |
| 2011/0020871 A1 | 1/2011 | Dave et al. |
| 2011/0281791 A1 | 11/2011 | Zion et al. |

FOREIGN PATENT DOCUMENTS

| | | |
|---|---|---|
| WO | WO 02/34893 A2 | 5/2002 |
| WO | WO 2004/009116 A2 | 1/2004 |
| WO | WO 2006/135930 A2 | 12/2006 |
| WO | WO 2010/064204 A2 | 6/2010 |
| WO | WO 2011/120994 A1 | 10/2011 |

OTHER PUBLICATIONS

Mowatt et al., Molecular and Biochemical Parasitology, 1991; 49: 215-228.*
Bowie et al., Science, 1990, 257:1306-1310.*
Adam, R. D., et al., "The *Giardia lamblia* vsp gene repertoire: characteristics, genomic organization, and evolution," *BMC Genomics* 11:424-438, BioMed Central Ltd., United Kingdom (2010).
Bennani-Baiti, I.M., et al., "Physical Linkage of the Human Growth Hormone Gene Cluster and the Skeletal Muscle Sodium Channel α-Subunit Gene (SCN4A) on Chromosome 17," *Genomics* 29:647-652, Academic Press, United States (1995).

(Continued)

*Primary Examiner* — Gary Nickol
*Assistant Examiner* — Lakia Tongue
(74) *Attorney, Agent, or Firm* — Sterne, Kessler, Goldstein & Fox P.L.L.C.

(57) ABSTRACT

The invention provides compositions for oral delivery and methods of treatment using VSP carriers, such as *Giardia* sp. variable surface proteins (VSP), to deliver therapeutic agents. VSP drug carriers can be combined with bioactive peptides, e.g., insulin, glucagon, or hGH, and be administered orally or mucosally. VSP carriers are resistant to acidic pHs and to proteolytic degradation and protect therapeutic agents from degradation in the gastrointestinal tract.

36 Claims, 12 Drawing Sheets

(56) References Cited

OTHER PUBLICATIONS

Brearley C., et al., "Pharmacokinetics of recombinant human growth hormone administered by cool click™ 2, a new needle-free device, compared with subcutaneous administration using a conventional syringe and needle," *BMC Clin Pharmacol* 7:10-17, BioMed Centeral Ltd., United Kingdom (2007).

Cefalu, K.W., et al., "Novel routes of insulin delivery for patients with type 1 or type 2 diabetes," *Ann Med* 33(9):579-586, The Finnish Medical Society Duodeeim, Finland (2001).

Deitsch, K.W., et al., "Shared Themes of Antigenic Variation and Virulence in Bacterial, Protozoal, and Fungal Infections," *Microbial Mol Biol Rev* 61(3):281-293, American Society for Microbiology, United States (1997).

Dewitt, D.E. and Hirsch, I.B., "Outpatient Insulin Therapy in Type 1 and Type 2 Diabetes Mellitus: Scientific Review," *JAMA* 289(17):2254-2264, (2003).

Franzén, O., et al., "Draft Genome Sequencing of *Giardia intestinalis* Assemblage B Isolate GS: Is Human Giardiasis Caused by Two Different Species?," *PLoS Pathog* 5(8):e1000560, 14 pages (2009).

Freemantle, N., et al., "Availability of Inhaled Insulin Promotes Greater Perceived Acceptance of Insulin Therapy in Patients With Type 2 Diabetes," *Diabetes Care* 28(2):427-428, American Diabetes Association, United States (2005).

Graham, A.S., et al., "Videos in Clinical Medicine: Central Venous Catheterization," *N Engl J Med* 356:e21, 3 pages, Massachusetts Medical Society, United States (2007).

Haro, L.S., et al., "Divalent metal cation chelators enhance chromatographic separation of structurally similar macromolecules: separation of human growth hormone isoforms," *J Chromatogr B* 720:39-47, Elsevier Science B.V., Netherlands (1998).

Hlavsa, M.C., et al., "Giardiasis Surveillance—United States, 1998-2002," *MMWR Surveill Summ* 54(SS01):9-16, Centers for Disease Control, United States (2005).

Jerlstrom-Hultqvist, J., et al., "Genome analysis and comparative genomics of a *Giardia intestinalis* assemblage E isolate," *BMC Genomics* 11:543-558, BioMed Central Ltd., United Kingdom (2010).

Longuet, C., et al., "The glucagon receptor is required for the adaptive metabolic response to fasting," *Cell Metab* 8(5):359-371, National Institutes of Health, United States (2008).

Lujan, H.D., "Mechanisms of adaptation in the intestinal parasite *Giardia lamblia*," *Essays Biochem* 51:177-191, Biochemical Society, United Kingdom (2011).

McMahon, G.T. and Arky, R.A., "Clinical Therapeutics: Inhaled Insulin for Diabetes Mellitus," *N Engl J Med* 356(5):497-502, Massachusetts Medical Society, United States (2007).

Meeran, K., et al., "Repeated Intracerebroventricular Administration of Glucagon-Like Peptide-1-(7-36) Amide or Exendin-(9-39) Alters Body Weight in the Rat," *Endocrinology* 140(1):244-250, The Endocrine Society, United States (1999).

Morrison, H.G., et al., "Genomic Minimalism in the Early Diverging Intestinal Parasite *Giardia lamblia*," *Science* 317:1921-1926, American Association for the Advancement of Science, United States (2007).

Nash, T.E., "Antigenic variation in *Giardia lamblia* and the host's immune response," *Phil Trans R Soc Lond B Biol Sci* 352:1369-1375, The Royal Society, Great Britain (1997).

Nash, T.E., "Surface antigenic variation in *Giardia lamblia*," *Mol Microbiol* 45(3):585-590, U.S. Government, United States (2002).

Peyrot, M., et al., "Resistance to Insulin Therapy Among Patients and Providers: Results of the cross-national Diabetes Attitudes, Wishes, and Needs (DAWN) study," *Diabetes Care* 28(11):2673-2679, American Diabetes Association, United States (2005).

Pimenta, P.F.P., et al., "Variant Surthee Antigens of *Giardia lamblia* Are Associated with the Presence of a Thick Cell Coat: Thin Section and Label Fracture Immunocytochemistry Survey," *Infect Immun* 59(11):3989-3996, American Association for Microbiology, United States (1991).

Prucca, C.G., et al., "Regulation of Antigenic Variation in *Giardia lamblia*,"*Annu Rev Microbiol* 65:611-630, Annual Reviews, United States (2011).

Prucca, C.G., et al., "Antigenic Variation in Giardia lamblia is regulated by RNA interference," *Nature* 456:750-754, Macmillan Publishers Limited, England (2008).

Prucca, C.G. and Lujan, H.D., "Antigenic variation in *Giardia lamblia*," *Cellular Microbiology* 11(12):1706-1715, Blackwell Publishing, England (2009).

Rivero, F.D., et al., "Disruption of antigenic variation is crucial for effective parasite vaccine," *Nat Med* 16(5):551-557, Nature Publishing Company, United States (2010).

Sonoda, H. and Sugimura, A., "Improved Solubilization of Recombinant Human Growth Hormone Inclusion Body Produced in *Escherichia coil*," *Biosci Biotechnol Biochem* 72(10):2675-2680, Japan Society for Bioscience, Biotechnology, and Agrochemistry, Japan (2008).

Such-Sanmartin, G., et al., "Generation of 5 and 17kDa human growth hormone fragments through limited proteolysis," *Growth Factors* 27(5):255-264, Informa UK Ltd., England (2009).

Summers, K.H., et al., "Preference for Insulin Delivery Systems Among Current Insulin Users and Nonusers," *Clin Ther* 26(9):1498-1505, Excerpta Medica, Inc., Netherlands (2004).

Zambrano-Villa, S. et al., "How protozoan parasites evade the immune response." *TRENDS in Parasitology* 18(6):272-278, Elsevier Science Ltd., England (2002).

Zeisel, H.J., et al., "Pharmacokinetics and Short-Term Metabolic Effects of Mammalian Cell-Derived Biosynthetic Human Growth Hormone in Man," *Horm Res* 37(suppl 2):5-13, Karger, Switzerland (1992).

International Search Report for International Application No. PCT/IB2013/001830, European Patent Office, Netherlands, mailed Jun. 12, 2013.

\* cited by examiner

A
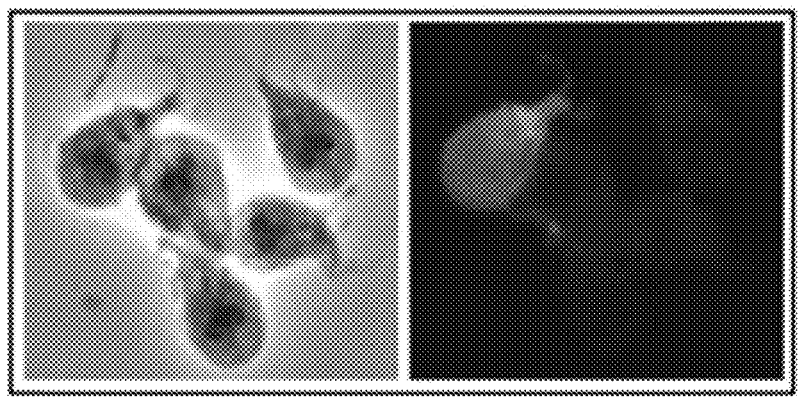
B
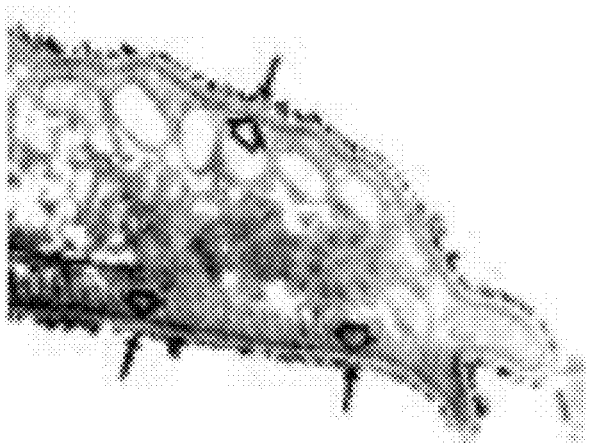
C
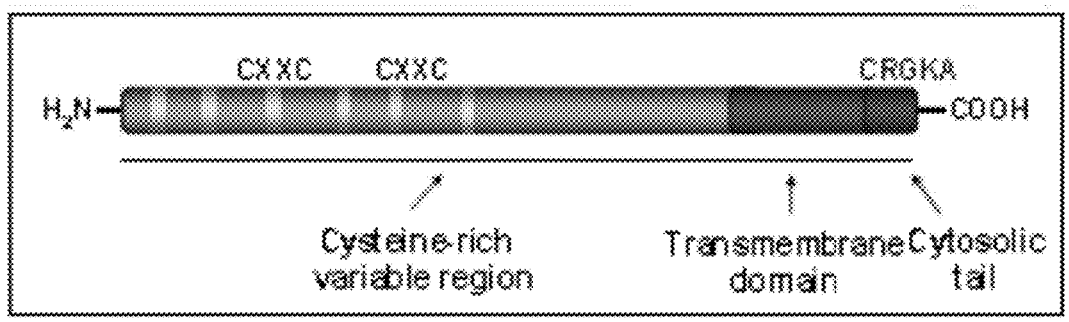
FIG. 1

A

MLLIAFYLILSTFAVDCKNSGNSCEAGQCDTIGDTEICMQCNQGKVPINGICTAHSEEAVTNAGCKKNGGTNIEESDK
VCGQCGNGYFLHKGGCYKIGEAPGNLICADEASNPGARTAGVCGACKDGYYKNSDAVATADSCIACEDANCATCGGAG
ENKCTKCIDGYFVGATGNEGGCIKCDATTGPNSYKGVAGCAKCEKPKNAGPAKCIECAADYLKTEADEQTSCVSEAVC
REGKTHFPTTDSAGGNKKVCVSCGTTNNGGIENCGECTSKESAARAGTEITCTKCSSNNLSPLGDACLTDCPAGTYAV
SGDSGSVCKPCHNTCAGCQTDDRETSCTACSPGYSLLYESNGATGRCVKECTGAFITNCADGQCTANVGGAKYCTQCK
DGYAPIDGICTAVAAAGRDVSVCTATGGKCTACTGNYALLSGGCYNTQTLPGKSVCKAVANSNDGKCKTCANGQAPDP
ATNFCPLCDSTCAECSTKNDADACTKCFPGYYKTGNKCIKCTESSNNGKKIDGIPDCLSCEAPINTGPAICYVKTDGT
SDDNSGNGGDSTNKSGLSTGHHHHHH (Recombinant VSP1267, SEQ ID NO: 1)

B

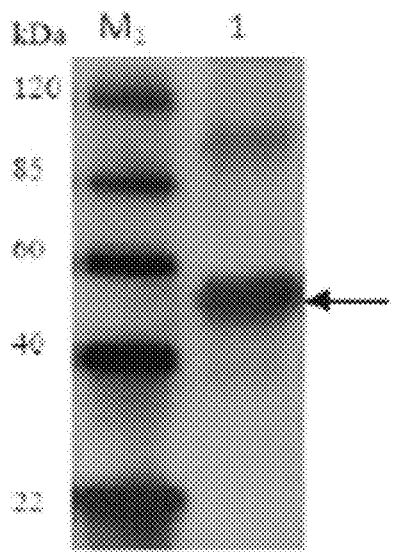

FIG. 5

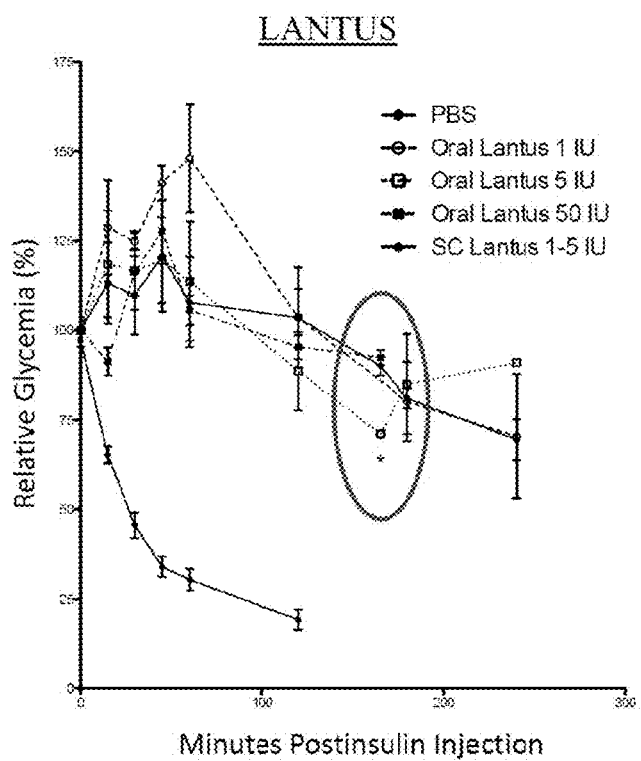
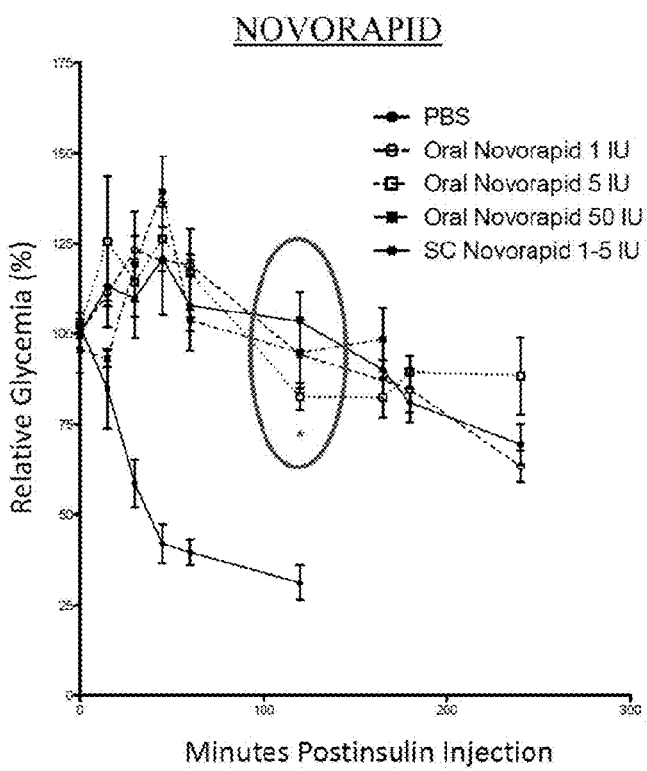
FIG. 7

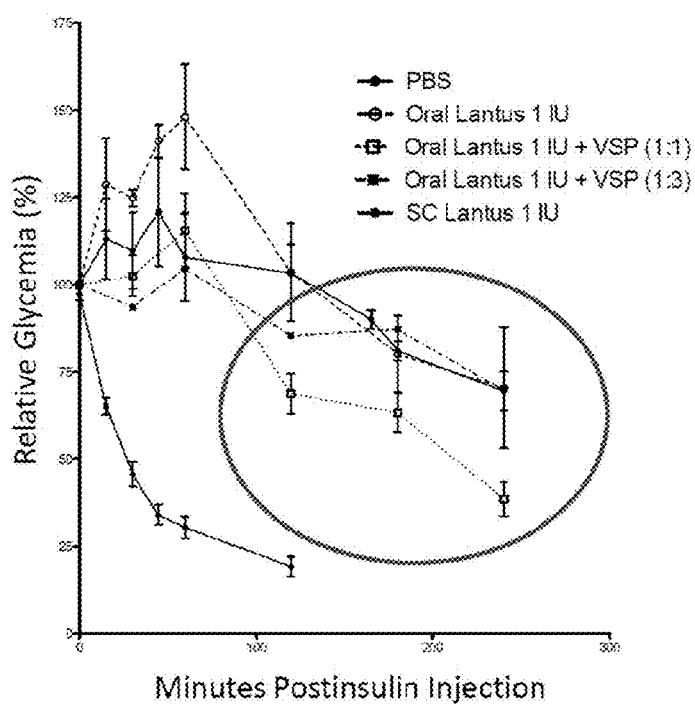
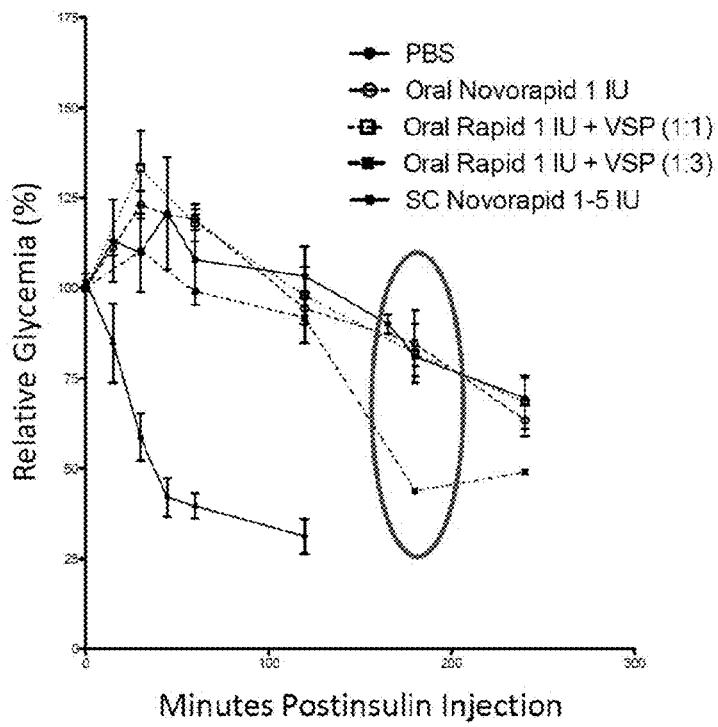
FIG. 8

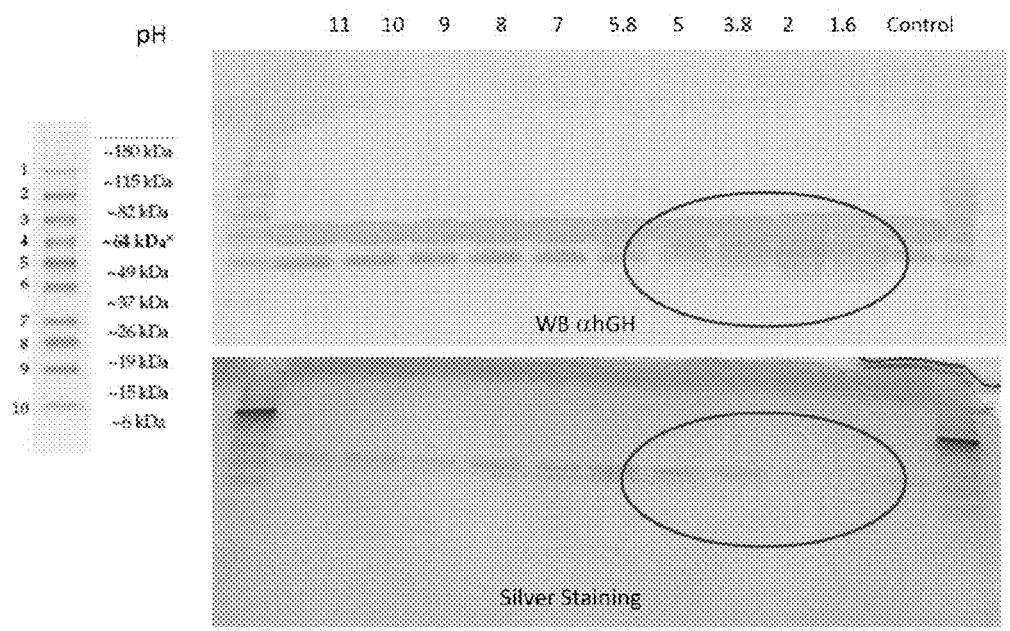
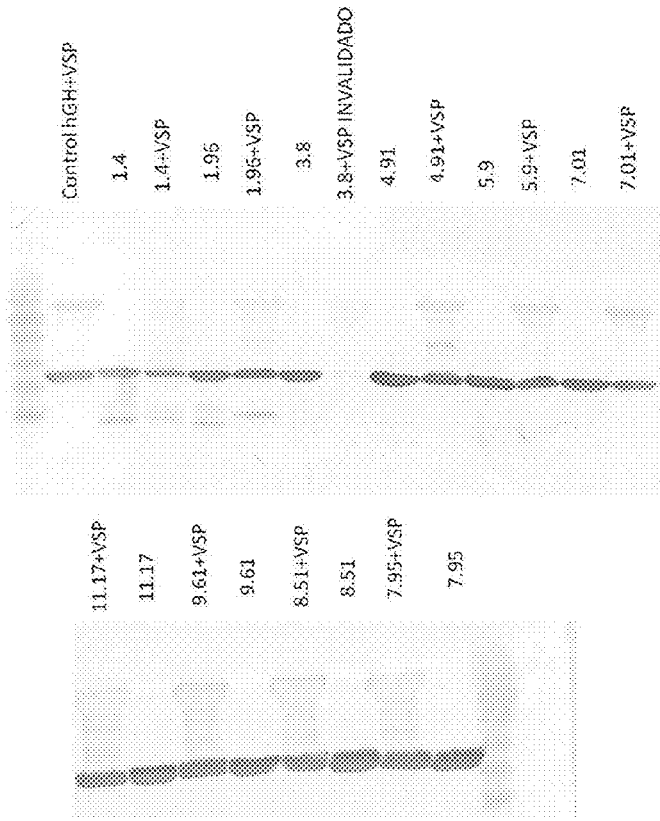
FIG. 10

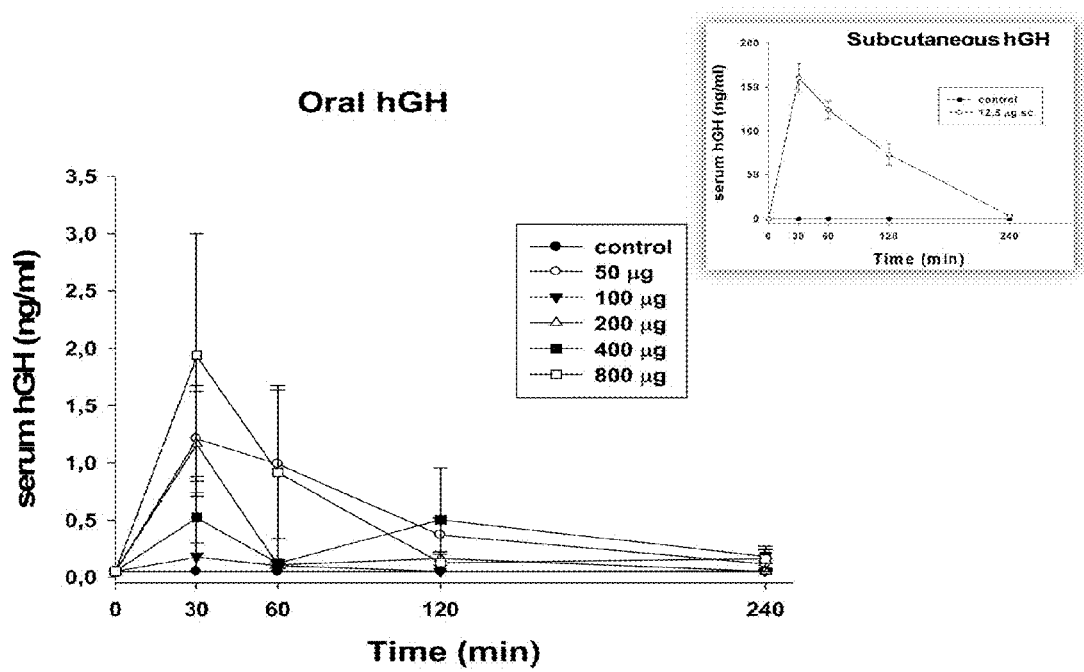
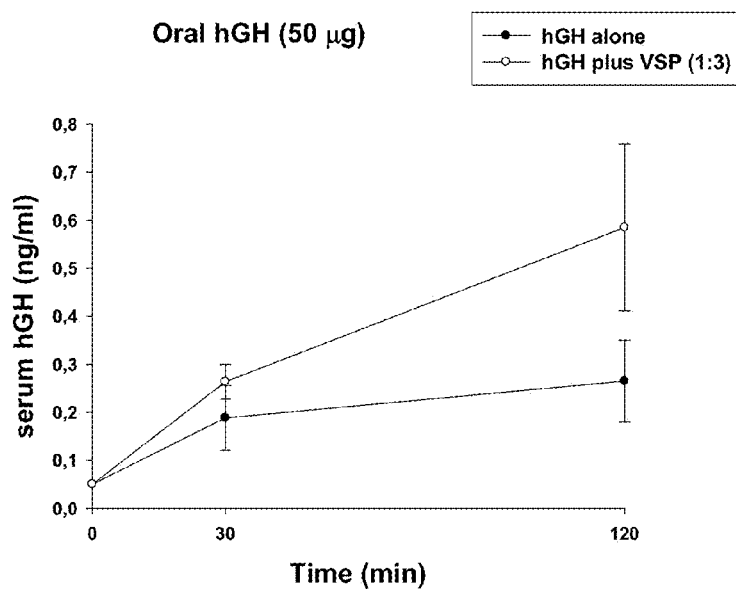
FIG. 12

PROTOZOAN VARIANT-SPECIFIC SURFACE PROTEINS (VSP) AS CARRIERS FOR ORAL DRUG DELIVERY

REFERENCE TO SEQUENCE LISTING SUBMITTED ELECTRONICALLY VIA EFS-WEB

The content of the electronically submitted sequence listing (Name: 3181_0010001_sequence_listing_ST25_ascii.txt; Size: 2,810,589 bytes, and Date of Creation: Oct. 1, 2014) filed with the application is incorporated herein by reference in its entirety.

BACKGROUND

The present invention relates to compositions and methods to deliver therapeutic agents to a subject in need thereof using polypeptide carriers. More particularly, the present invention relates to polypeptides such as *Giardia* sp. variable surface proteins (VSPs) that act as carriers for the delivery of therapeutic agents such as bioactive peptides.

Oral delivery represents the ideal means of delivering prophylactic and therapeutic agents because of ease of administration, patient compliance, and cost. However, the oral route is also the most difficult because of the numerous barriers posed by the gastrointestinal tract (GIT). The main challenges are enzymatic degradation in the stomach and upper intestinal tract, and lack of sufficient permeability through the GIT. Low pH in the stomach can subject therapeutic agents to physical and chemical degradation. Physical degradation of peptides generally involves modification of the native structure of a protein to a higher-order structure which may be a result of adsorption, aggregation, unfolding, precipitation, and/or complete/partial degradation to its amino acidic components. Chemical degradation usually involves blond cleavage and leads to the formation of a new product.

*Giardia* is an intestinal pathogen which is capable of surviving the harsh environmental conditions in the stomach and the upper small intestine. Like many protozoan microorganisms, *Giardia* undergoes antigenic variation (see, e.g., Zambrano-Villa et al., Trends Parasitol. 18: 272-8 (2002)), a mechanism by which it continuously switches its major surface molecules allowing the parasite to evade the host's immune response and establish chronic and/or recurrent infections (see, e.g., Nash, Mol. Microbiol. 45:585-90 (2002)). These surface antigens belong to a family of Variant-specific Surface Proteins (VSPs), which are integral membrane proteins that cover the entire surface of trophozoites.

VSPs possess a cysteine-rich amino-terminal region, and a conserved carboxy-terminal domain including a transmembrane region and a short cytoplasmic tail (FIG. 1C). There is a repertoire of about 200 VSP genes in the *Giardia*'s genome, but only one VSP is expressed on the surface of the parasite at any given time (see, e.g., Prucca et al., Nature 456(7223):750-4 (2008); Deitsch et al., Microbiol. Mol. Biol. Rev. 61:281-93 (1997)).

Since the extracellular portion of *Giardia* VSPs allows the parasite to survive within the hostile environment of the upper small intestine, VSPs covalently bound to antigens have been used to shuttle candidate antigens. It has been observed that when vaccines comprising VSPs covalently bound to *Giardia* antigens are administered orally, the vaccines fully protect animals from subsequent infections by the *Giardia* parasite, indicating that the antigens have survived the passage through the GIT (Rivero et al., Nat. Med. 16(5):551-7 (2010), see, e.g., PCT Pub. Nos. WP2010/064204 and WO2011/120994, which are herein incorporated by reference in their entireties).

Type 1 diabetes is usually diagnosed in children and young adults, and is responsible for a growing proportion of national health care expenditures. Type 1 diabetes is an autoimmune disease that results from a dysfunction of the immune system that attacks and destroys the β-cells of the pancreatic islets producing insulin.

Administration of exogenous insulin is the only medication that can be used to control the increases in blood sugar that occur with the disease. Type 2 diabetes, by contrast, is characterized by defects in both insulin secretion and insulin action, with insulin deficiency usually emerging later during the course of the disease. Insulin supplementation is often required to attain good glucose levels control in this disease (see, e.g., DeWitt & Hirsch, JAMA 289:2254-2264 (2003)). There are different types of subcutaneous insulin available (Summers et al., Clin. Ther. 26:1498-1505 (2004)). However, surveys indicate substantial resistance to insulin therapy on the part of patients with type 2 diabetes due to anticipated pain and inconvenience (Peyrot et al., Diabetes Care 28:2673-2679 (2005)). The youngest and oldest patients are least likely to accept injectable therapy and thus pose the greatest challenge for physicians who want to initiate insulin treatment (Freemantle et al., Diabetes Care 28:427-428 (2005)). Consequently, efforts to develop oral, nasal, and inhaled formulations of insulin have been driven by the preference of patients to avoid subcutaneous injections (Cefalu, Ann. Med. 33:579-586 (2001); Graham et al., N. Engl. J. Med. 356:497-502 (2007)). Thus, the option of delivering insulin by the oral route remains an attractive therapeutic strategy.

Glucagon, a peptide hormone secreted by the pancreas, raises blood glucose levels. Its effect is opposite that of insulin, which lowers blood glucose levels. Glucagon is indicated and used as a treatment for severe hypoglycemia. Because patients with type 1 diabetes may have less of an increase in blood glucose levels compared with a stable type 2 patient, supplementary carbohydrates should be given as soon as possible, especially to a pediatric patient. Glucagon is also indicated as a diagnostic aid in the radiologic examination of the stomach, duodenum, small bowel, and colon when diminished intestinal motility would be advantageous. Glucagon is as effective for this examination as are the anticholinergic drugs. However, the addition of the anticholinergic agent may result in increased side effects. As in the case of insulin, the development of forms of glucagon suitable for oral delivery is an attractive therapeutic strategy.

Growth hormone deficiency is a disorder that involves the pituitary gland, which produces growth hormone and other hormones. Human growth hormone (hGH) stimulates growth and cell reproduction in humans, also exerting its action on metabolism of lipids, proteins and carbohydrates. Recombinant hGH is commonly produced by bacterial fermentation (Zeisel et al., Horm. Res. 37(Suppl 2):5-13 (1992); Sonoda & Sigimura, Biosci. Biotechnol. Biochem. 72:2675-80 (2008)). When the pituitary gland does not produce enough growth hormone, growth will be slower than normal. Growth hormone is needed for normal growth in children. In adults, growth hormone is needed to maintain the proper amounts of body fat, muscle, and bone. hGH deficiency can occur at any age. Children and some adults with growth hormone deficiency will benefit from growth hormone therapy. To treat growth hormone deficiencies, hGH (human growth hormone) is generally prescribed. hGH is an injectable drug which is injected underneath the fat of the patient's skin several times a week (Brearley et al., BMC Clin. Pharmacol. 7:10 (2007)). As in the case of insulin treatment, patient's resistance to the initiation injectable therapy and compliance pose challenges for physicians. Accordingly, the development of hGH forms suitable for oral delivery is an attractive therapeutic strategy.

BRIEF SUMMARY

The present disclosure provides compositions and methods comprising VSP-carriers for the delivery of therapeutic agents, e.g., bioactive peptides such as insulin, glucagon, or growth hormone, to a target location in a subject in need thereof, for example, via oral or mucosal administration.

More particularly, the disclosure provides the use of a VSP polypeptide, e.g., a Giardia parasite's variable surface protein (VSP) or a fragment thereof (e.g., the extracellular domain of a Giardia VSP or a CXXC (SEQ ID NO:589) motif-comprising fragment thereof) as a carrier to deliver a therapeutic agent via oral or mucosal administration. VSP carriers of the invention are not covalently bound to the therapeutic agents via peptidic bonds Accordingly, the present disclosure provides a therapeutic composition comprising a VSP carrier and a therapeutic agent. In some embodiments, the composition is formulated for oral administration. In other embodiments, the composition is formulated for mucosal administration. In some embodiments, the VSP carrier is a VSP, a VSP-like protein, a VSP or VSP-like protein fragment, a VSP or VSP-like protein derivative, or a combination of two or more of said VSP carriers.

In some embodiments, the VSP carrier comprises a VSP from Giardia or a fragment thereof. In other embodiments, the VSP from Giardia or a fragment thereof comprises a VSP extracellular domain. In other embodiments, the VSP from Giardia is VSP1267. In some specific embodiments, the VSP carrier comprises the amino acid sequence of SEQ ID NO:2. In other embodiments, the VSP carrier further comprises a heterologous moiety. In some embodiments, the heterologous moiety is a protein purification tag sequence. In some embodiments, the protein purification tag sequence is a His6 tag. In some specific embodiments, the VSP carrier consists of the sequence of SEQ ID NO:1.

In some embodiments, the therapeutic agent is a biological agent. In some embodiments, the biological agent is a bioactive peptide. In some embodiments, the bioactive peptide is insulin, human growth hormone, glucagon, fragments, analogs, derivatives or variants thereof, or a combination of two or more of said bioactive peptides. In some embodiments, the bioactive peptide is a natural insulin. In other embodiments, the bioactive peptide is a recombinant insulin. In some embodiments, the bioactive peptide is an insulin analog. In other embodiments, the insulin analog is a fast-acting insulin. In other embodiments, the insulin analog is a long-acting insulin. In some embodiments, the fast-acting insulin is insulin aspart. In other embodiments, the long-acting insulin is insulin glargine.

In some embodiments, the molecule to molecule ratio of VSP carrier to the therapeutic agent ranges from about 10:1 to about 1:10. In other embodiments, the molecule to molecule ratio of VSP carrier to the therapeutic agent ranges from about 3:1 to about 1:3. In some embodiments, the molecule to molecule ratio of VSP carrier to the therapeutic agent is 3:1. In other embodiments, the molecule to molecule ratio of VSP carrier to the therapeutic agent is 1:1. In some embodiments, the composition further comprises a pharmaceutically acceptable excipient.

Also provided is a method of delivering a therapeutic agent to a target location in a subject comprising administering a therapeutic composition comprising a VSP carrier and a therapeutic agent to a subject in need thereof. The present disclosure also provides a method of treating a disease or condition in a subject comprising administering an effective amount of a therapeutic composition comprising a VSP carrier and a therapeutic agent to a subject in need thereof. In some embodiments, the disease or condition is a hormone deficiency. In some embodiments, the hormone deficiency is an insulin deficiency. In some embodiments, the insulin deficiency is type 1 diabetes.

Also provided is a method of treating a disease or condition in a subject comprising combining a VSP carrier and a therapeutic agent, where the VSP carrier binds to the therapeutic agent, and administering an effective amount of the combination of VSP carrier and therapeutic agent to the subject. The instant disclosure also provides a method of increasing the resistance of a therapeutic agent to enzymatic degradation comprising combining a VSP carrier and a therapeutic agent, where the VSP carrier can bind to the therapeutic agent, and wherein combining the VSP carrier and the therapeutic agent results in increased resistance of the therapeutic agent to enzymatic degradation.

The present disclosure also provides a method of increasing the resistance of a therapeutic agent to pH denaturation comprising combining a VSP carrier and a therapeutic agent, where the VSP carrier can bind to the therapeutic agent, and where combining the VSP carrier and the therapeutic agent results in increased resistance of the therapeutic agent to pH denaturation. Also provided is a method of increasing the attachability of a therapeutic agent to mucosal epithelial cells comprising combining a VSP carrier and a therapeutic agent, where the VSP carrier can bind to the therapeutic agent, and where combining the VSP carrier and the therapeutic agent results in increased attachability of the therapeutic to mucosal epithelial cells. In some embodiments, the mucosal epithelial cells are intestinal epithelial cells. In other embodiments, the mucosal epithelial cells are gastric epithelial cells. In some embodiments, the mucosal epithelial cells are oral epithelial cells.

Also provided is a method of making an orally deliverable composition, comprising combining a VSP carrier and a therapeutic agent, where the VSP carrier can bind to the therapeutic agent. The present disclosure also provides a method of making an injectable composition suitable for oral administration comprising combining a VSP carrier and a therapeutic agent, where the VSP carrier can bind to the therapeutic agent. For example, an injectable insulin composition can be reformulated or made suitable for oral administration by combining the injectable composition with a VSP carrier. In some embodiments, the VSP carrier is a VSP, a VSP-like protein, a VSP or VSP-like protein fragment, a VSP or VSP-like protein derivative, or a combination of two or more of said VSP carriers. In some embodiments, the VSP carrier comprises a VSP from Giardia or a fragment thereof. In other embodiments, the VSP from Giardia or a fragment thereof comprises a VSP extracellular domain. In some embodiments, the VSP from Giardia is VSP1267. In other embodiments, the VSP carrier comprises the amino acid sequence of SEQ ID NO:2. In some embodiments, the VSP carrier further comprises a heterologous moiety. In other embodiments, the heterologous moiety is a protein purification tag sequence. In some embodiments, the protein purification tag sequence is a His6 tag. In other embodiments, the VSP carrier consists of the sequence of SEQ ID NO:1. In some embodiments, the therapeutic agent is a biological agent. In other embodiments, the biological agent is a bioactive peptide. In some embodiments, the bioactive peptide is insulin, human growth hormone, glucagon, fragments, analogs, derivatives or variants thereof, or a combination of two or more of said bioactive peptides. In some embodiments, the bioactive peptide is a natural insulin. In other embodiments, the bioactive peptide is a recombinant insulin. In some embodiments, the bioactive peptide is an insulin analog. In other embodiments, the insulin analog is a fast-acting insulin. In some embodiments, the insulin analog is a long-acting insulin. In other embodiments, the fast-acting insulin is insulin aspart. In some other embodiments, the long-acting insulin is insulin glargine.

BRIEF DESCRIPTION OF THE DRAWINGS/FIGURES

FIG. 1A shows phase contrast (left panel) and immunofluorescence (right panel) assays showing that a group of *Giardia* trophozoites. Each trophozoite expresses a single VSP on its surface, which is different for each trophozoite as demonstrated by surface labeling with an anti-VSP specific monoclonal antibody.

FIG. 1B shows an anti-VSP specific immunogold labeling of the surface of a trophozoite. The entire surface of the parasite is labeled, including the ventral disk and the flagella, generating a thick surface coat.

FIG. 1C is a diagram showing the structural characteristics of VSPs. The diagram shows that VSPs are integral membrane proteins with a variable extracellular region rich in CXXC (SEQ ID NO:589) motifs (where C indicates a cysteine and X can be any amino acid), a unique transmembrane hydrophobic regions and a short, 5 amino acids long cytoplasmic tail.

Figure 2:
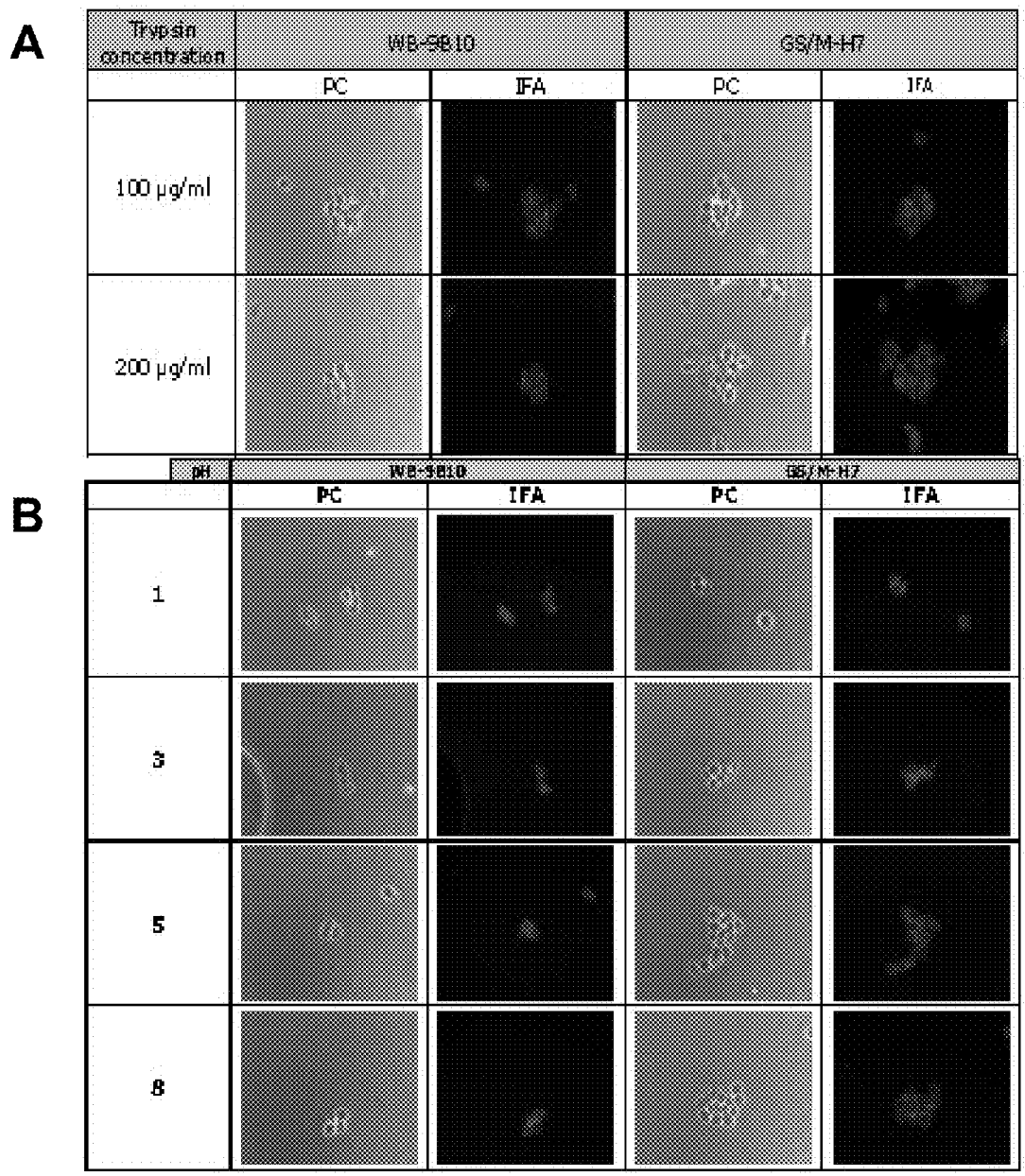

FIG. 2A shows phase contrast (PC) images and immunofluorescent (IFA) images corresponding to two different *Giardia* isolates (WB and GS/M) treated with 100 μg/ml or 200 □g/ml trypsin. The monoclonal antibody G10/4 recognizes a conformational epitope in the VSPH7 VSP protein of the GS/M isolate. The monoclonal antibody 9B10 detects a non-conformational epitope in the VSP9B10 VSP protein of the WB isolate.

FIG. 2B shows phase contrast (PC) images and immunofluorescent (IFA) images corresponding to two different *Giardia* isolates (WB and GS/M) incubated at different pHs (1, 3, 5 and 8). The monoclonal antibody G10/4 recognizes a conformational epitope in the VSPH7 VSP protein of the GS/M isolate. The monoclonal antibody 9B10 detects a non-conformational epitope in the VSP9B10 VSP protein of the WB isolate.

Figure 3:
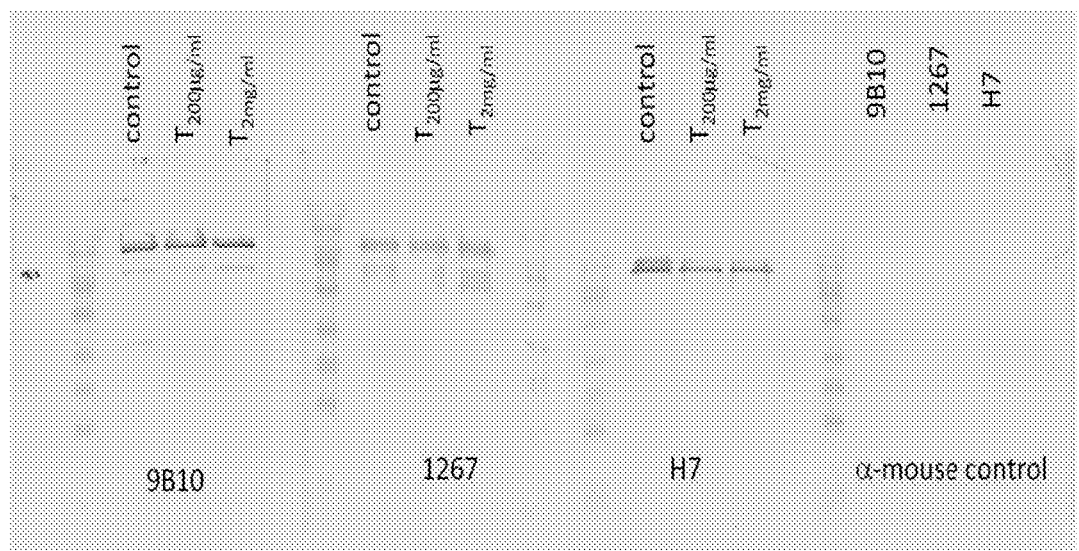

FIG. 3 shows a Western blot analysis detecting the presence of three *Giardia* VSPs (VSP9B10, VSP1267 and VSPH7) after trophozoite trypsinization. Trophozoites were treated with trypsin at 200 μg/ml and 2 mg/ml concentrations, or incubated in medium without trypsin (control). A control sample corresponding to a mouse anti-alkaline phosphatase antibody (α-mouse) in also shown.

Figure 4:
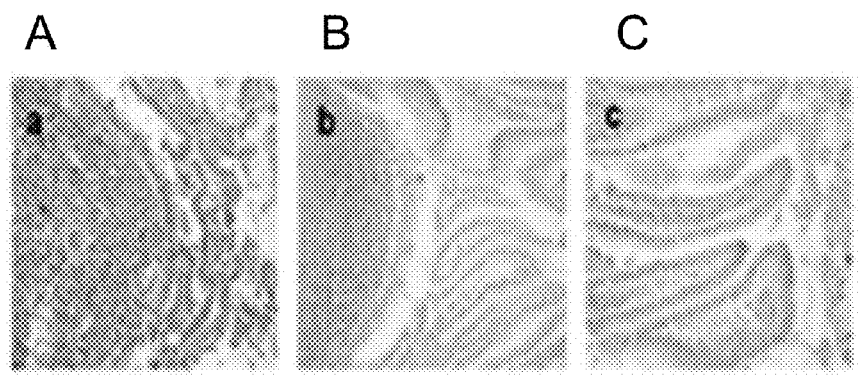

FIG. 4 shows immunohistochemistry microphotographs of intestinal sections from gerbils infected with WB9B10 *Giardia* trophozoites (FIG. 4A), non-infected gerbils (FIG. 4B), and gerbils immunized with the entire repertoire of *Giardia* VSPs purified from transgenic trophozoites (FIG. 4C).

FIG. 5A shows the amino acid sequence of a recombinant *Giardia* VSP corresponding to the extracellular portion of VSP1267 plus a C-terminal His6 tag (boxed amino acids) (SEQ ID NO:1). The N-terminal signal peptide is underlined.

FIG. 5B shows a Western blot detecting the recombinant VSP1267 using an anti-His6 monoclonal antibody.

Figure 6:
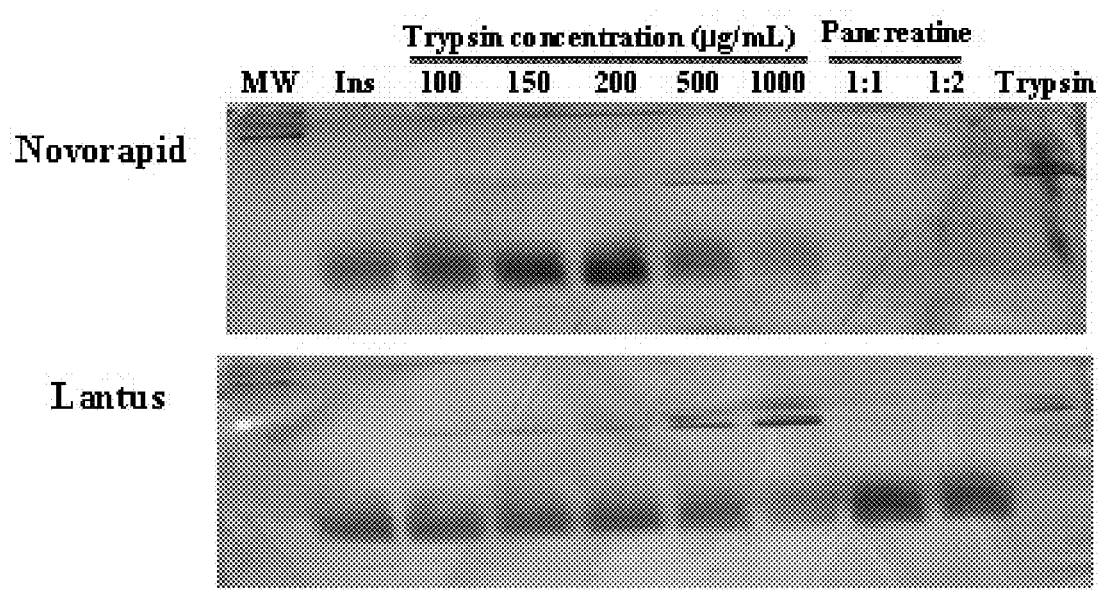

FIG. 6 shows silver stained gels corresponding to insulins (NOVORAPID® and LANTUS®) preincubated with different concentrations of trypsin and pancreatine (a mixture of pancreatic juice components). The lane labeled MW corresponds to a molecular weight ladder. The "ins" and "trypsin" lanes are control lanes containing insulin and trypsin, respectively.

FIG. 7 shows blood glucose levels in female Balb/c mice, 7 weeks-old, which were left without food intake for 2 hours and then received the indicated doses of insulin. FIG. 7A shows blood glucose levels after LANTUS® administration; whereas FIG. 7B shows blood glucose levels after NOVORAPID® administration. The insulins were administered orally at 1 IU, 5 IU, and 50 IU doses. PBS and a subcutaneous administration of insulin at 1-5 IU were used as controls. 1 IU seemed to be a suboptimal dose for both insulins (circled).

FIG. 8 shows blood glucose levels in female Balb/c mice, 7 weeks-old, which were left without food intake for 2 hours and then received the indicated doses of insulin, alone or combined with a VSP carrier. FIG. 8A shows blood glucose levels after LANTUS® administration; whereas FIG. 8B shows blood glucose levels after NOVORAPID® administration. The insulins were administered at the suboptimal dose identified in FIG. 7 (1 IU) in three different formulations (i) insulin administered alone, (ii) insulin combined with VSP at a 1:1 molecule to molecule ratio, and (iii) insulin combined with VSP at a 1:3 molecule to molecule ratio. PBS and a subcutaneous administration of insulin at 1-5 IU were used as controls. The combination of 1 IU of insulin with a VSP carrier enhanced insulin's biological action, at a 1:1 insulin to VSP carrier ratio for LANTUS® and at a 1:3 insulin to VSP carrier ratio for NOVORAPID® (circled).

Figure 9:
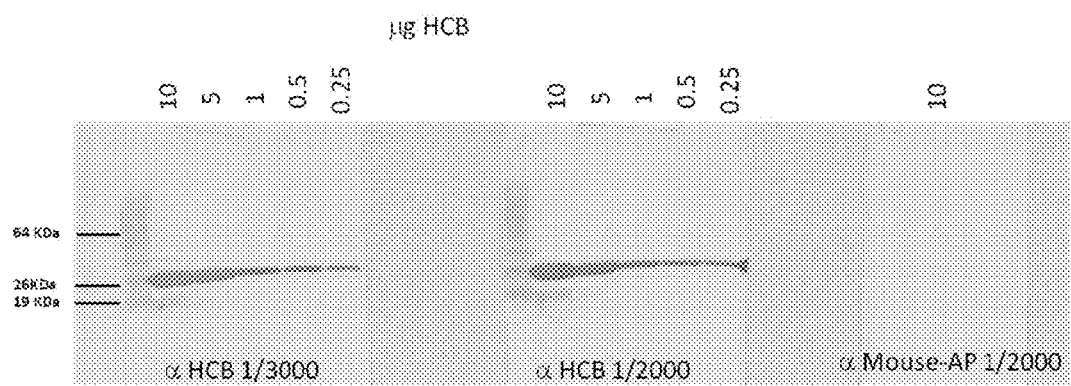

FIG. 9 shows the specificity of the anti-hGH monoclonal antibody (α HCB) by Western blot. Two dilutions of the monoclonal αHCB (1/3000 and 1/2000) were used to detect hGH (HCB: human growth hormone produced in transgenic bovines). A control containing an anti-alkaline phosphatase antibody (αMouse-AP1) is also shown.

FIG. 10A shows the effect of pH on the stability of hGH. The top image is a Western blot showing the pH-mediated degradation of hGH incubated in medium at pH 1.6, 2.0, 3.8, 5.0, 5.8, 7.0, 8.0, 9.0, 10.0, and 11.0. The presence of hGH was determined using an anti-hGH monoclonal antibody. The bottom image shows the silver staining detection of hGH. Low pHs, similar to those found in the GIT, caused degradation of the protein (circles), while at higher pHs the hGH remained unaltered as compared with the control. Each lane contained 10 μg of hGH.

FIG. 10B shows the effect of combining a VSP carrier with hGH on the hGH denaturation at low pH. The Western blots correspond to pairs of samples in which hGH samples without a VSP carrier or with a VSP carrier at a 1:3 hGH to VSP carrier ratio were subjected to the same pH conditions (pH 1.4, 1.96, 3.8, 4.91, 5.9, 7.01, 7.95, 8.51, 9.61, and 11.17). The hGH:VSP carrier sample at pH 3.8 was lost during processing. The presence of hGH was determined using an anti-hGH monoclonal antibody.

Figure 11:
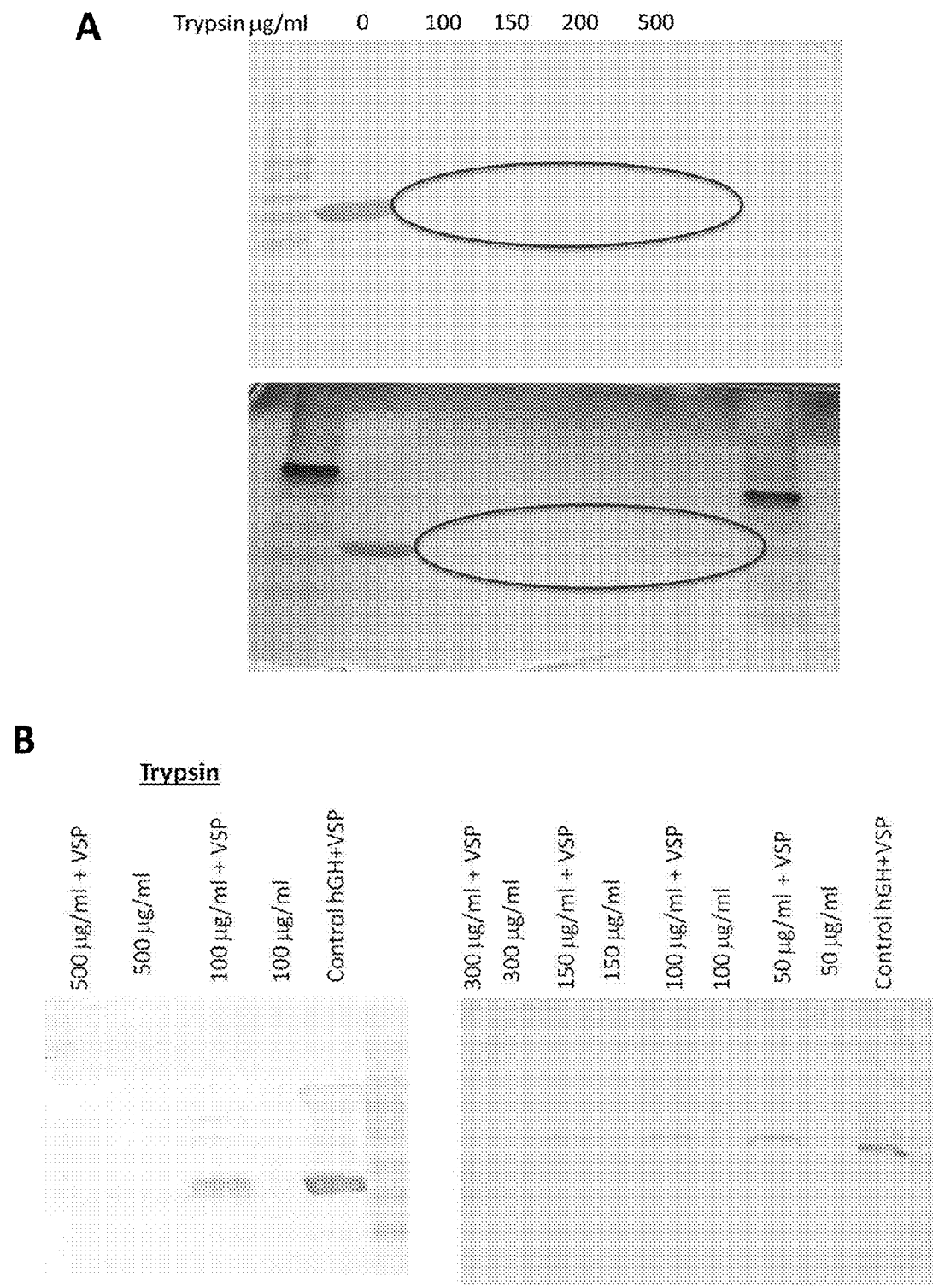

FIG. 11A shows the effect of trypsin on the stability of hGH. The top image is a Western blot staining using an anti-hGH monoclonal antibody. The bottom image corresponds to silver staining. Trypsin completely proteolyzed hGH as indicated by the circled areas.

FIG. 11B shows that combining a VSP carrier with hGH at a 1:3 hGH to VSP ratio protects hGH from trypsin degradation up to 150 µg/ml trypsin. The Western blots correspond to pairs of samples in which hGH samples without a VSP carrier, or with a VSP carrier at a 1:3 hGH to VSP carrier ratio were subjected to the same trypsin concentrations (50, 100, 150, 300 and 500 µg/ml). The presence of hGH was determined using an anti-hGH monoclonal antibody.

FIG. 12A shows in its main panel the serum levels of hGH in mice after oral administration of the specified hGH doses (50, 100, 200, 400 and 800 µg). The inset shows the serum levels of hGH in mice after subcutaneous administration of a 12.5 µg dose of hGH.

FIG. 12B shows serum levels of hGH in mice after oral administration of hGH alone or in combination with a VSP carrier at a 1:3 hGH to VSP carrier ratio.

Figure 13:
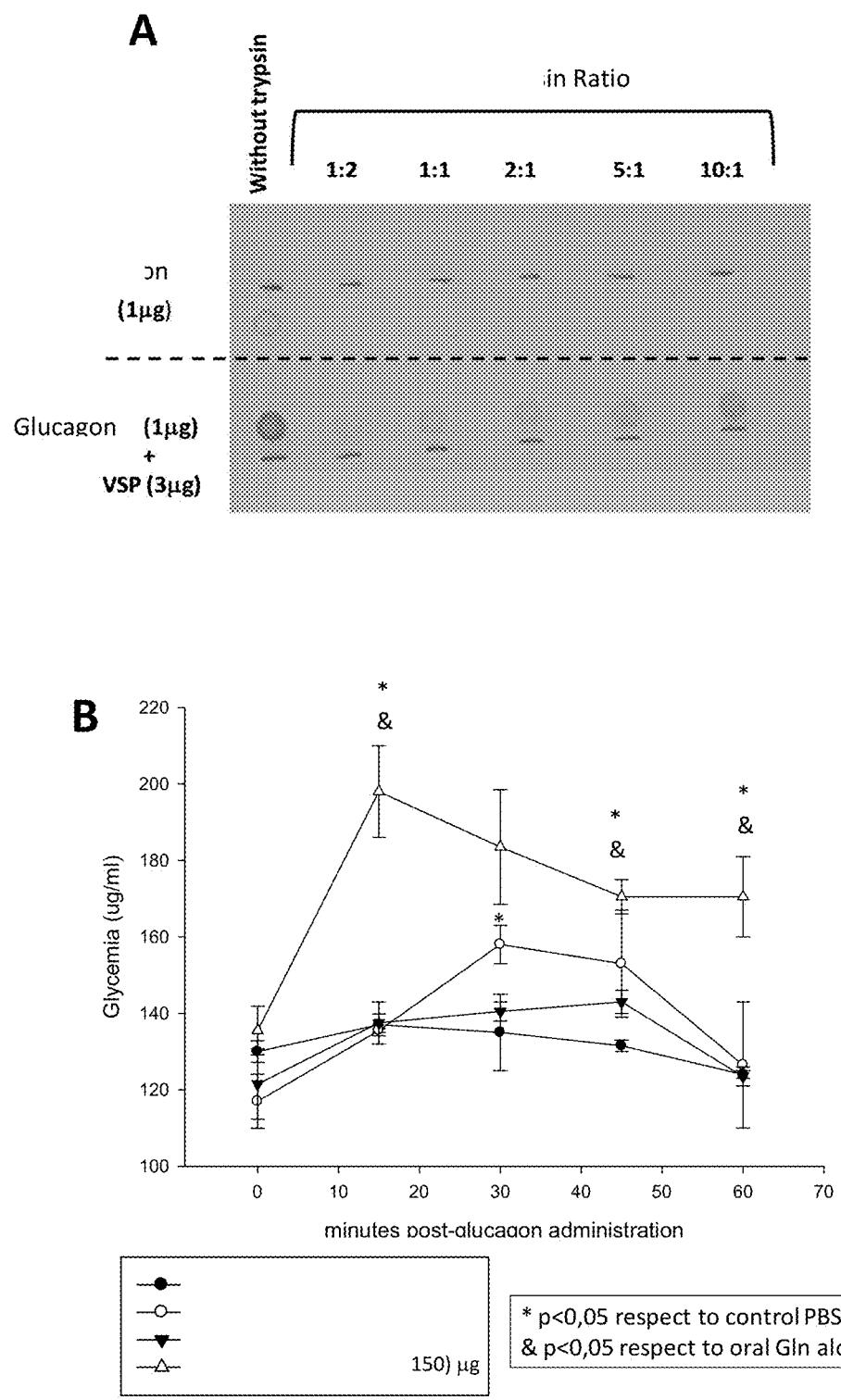

FIG. 13A shows the effect of trypsin on the stability of glucagon. The top panel of the Dot blot shows Trypsin proteolyzed glucagon. The bottom panel shows that combining a VSP carrier with glucagon at a 1:3 glucagon to VSP ratio protects glucagon from trypsin degradation up to 1:2 (protein:protease) ratio.

FIG. 13B shows the effect on blood glucose levels resulting from oral administration of glucagon alone or combined with VSP to BALC/c mice.

DETAILED DESCRIPTION

Oral delivery of bioactive peptides such as insulin, glucagon, or growth hormone, which generally are administered via injection, offers considerable benefits in terms of decreased number of injections, improved compliance, and reduced incidence of side effects. However, successful oral delivery of therapeutic agents, e.g., bioactive peptides such as insulin, glucagon, or human growth hormone (hGH), involves overcoming the barriers of enzymatic degradation, achieving epithelial permeability, and taking steps to conserve bioactivity during the formulation process. To address this problem, we provide an oral delivery system in which bioactive peptides, e.g., insulin, glucagon, or hGH, are combined with, but not covalently combined via peptide bonds, with a VSP carrier to protect the bioactive peptides from degradation in the gastrointestinal track (GIT) and to promote its systemic biological action.

Accordingly, the present disclosure is directed to therapeutic compositions comprising VSP carriers (e.g., *Giardia* VSPs, VSP-like proteins, fragments, variants, or derivatives thereof) comprising at least one CXXC (SEQ ID NO:589) motif, wherein C represents a cysteine amino acid and X represents any amino acid, which can be combined and bind to therapeutic agents and function as carriers for drug delivery. The disclosure relates in particular to compositions comprising VSP carriers, e.g., polypeptides derived from the extracellular domain of *Giardia* VSP, which are resistant to proteases and different pHs, and which are able to attach to epithelial cells in the GIT. In some embodiments, such VSP carriers are used to form Virus-Like-Particles (VLPs) suitable to be administered orally.

The combination of therapeutic agents with VSP carriers for oral or mucosal administration confers to such therapeutic agents increased resistance to pH-induced degradation and enzymatic degradation, as well as increasing the binding of such therapeutic agents to the gastrointestinal epithelium. In some specific aspects, the therapeutics agents are bioactive peptides such as insulins, glucagon, or human growth hormone.

DEFINITIONS

It must be noted that, as used in this specification and the appended claims, the singular forms "a," "an" and "the" include plural referents unless the context clearly dictates otherwise. The terms "a" (or "an"), as well as the terms "one or more," and "at least one" can be used interchangeably herein.

Furthermore, "and/or" where used herein is to be taken as specific disclosure of each of the two specified features or components with or without the other. Thus, the term "and/or" as used in a phrase such as "A and/or B" herein is intended to include "A and B," "A or B," "A," (alone) and "B" (alone). Likewise, the term "and/or" as used in a phrase such as "A, B, and/or C" is intended to encompass each of the following embodiments: A, B, and C; A, B, or C; A or C; A or B; B or C; A and C; A and B; B and C; A (alone); B (alone); and C (alone).

Unless defined otherwise, all technical and scientific terms used herein have the same meaning as commonly understood by one of ordinary skill in the art to which this invention is related. For example, the Concise Dictionary of Biomedicine and Molecular Biology, Juo, Pei-Show, 2nd ed., 2002, CRC Press; The Dictionary of Cell and Molecular Biology, 3rd ed., 1999, Academic Press; and the Oxford Dictionary Of Biochemistry And Molecular Biology, Revised, 2000, Oxford University Press, provide one of skill with a general dictionary of many of the terms used in this disclosure.

Units, prefixes, and symbols are denoted in their Système International de Unites (SI) accepted form. Numeric ranges are inclusive of the numbers defining the range. Unless otherwise indicated, amino acid sequences are written left to right in amino to carboxy orientation. The headings provided herein are not limitations of the various aspects or embodiments of the invention, which can be had by reference to the specification as a whole. Accordingly, the terms defined immediately below are more fully defined by reference to the specification in its entirety.

It is understood that wherever embodiments are described herein with the language "comprising," otherwise analogous embodiments described in terms of "consisting of" and/or "consisting essentially of" are also provided.

Amino acids are referred to herein by either their commonly known three letter symbols or by the one-letter symbols recommended by the IUPAC-IUB Biochemical Nomenclature Commission. Nucleotides, likewise, are referred to by their commonly accepted single-letter codes.

As used herein, the terms "*Giardia*" or "*Giardia* parasite" refer to a genus of anaerobic flagellated protozoan parasites of the phylum Metamonada that colonize and reproduce in the small intestines of several vertebrates, causing giardiasis. World-wide, giardiasis is common among people with poor fecal-oral hygiene, and major modes of transmission include contaminated water supplies or sexual activity. Flagellated *Giardia* trophozoites attach to epithelial cells of the small intestine (i.e., the surface of the intestinal mucosa), where they can cause disease without triggering a pronounced inflammatory response (Rivero et al., Nat. Med. 16(5):551-7 (2010)). There are no known virulence factors or toxins, and variable expression of surface proteins allows evasion of host immune responses and adaptation to different host environments (Rivero et al., Nat. Med. 16(5):551-7 (2010)). Their life cycle alternates between an actively swimming trophozoite and an infective, resistant cyst. The *Giardia* parasite infects humans, but is also one of the most common parasites infecting cats, dogs and birds. Mammalian hosts also include cows, beavers, deer, and sheep.

The term "*Giardia*" encompasses different species, including *Giardia lamblia* and *Giardia muris*. As used herein, the term "*Giardia lamblia*" (also called *Giardia intestinalis* or *Giardia duodenalis*) refers to one of the most common intestinal parasites of humans. *Giardia lamblia* is the most prevalent parasitic protist in the United States, where its incidence may be as high as 0.7% (Hlaysa et al., MMWR Surveill. Summ. 54:9-16 (2005)).

As used herein, the terms "variable surface protein," "VSP protein," or "VSP" refer to polypeptides that cover the entire surface of the *Giardia* parasite and are the major antigens recognized by the host immune system. The term "VSP" as defined herein also includes homologs, e.g., orthologs and paralogs of "VSP" proteins from *Giardia*, VSP and VSP-like proteins found in other organisms, as well as fragments, variants, and derivatives thereof.

The term "homolog," used with respect to a VSP protein or VSP-encoding gene of a first family or species, refers to distinct VSP protein or VSP-encoding genes of a second family or species which are determined by functional, structural, or genomic analyses to be an VSP protein or VSP-encoding gene of the second family or species which corresponds to the original VSP protein or VSP-encoding gene of the first family or species. As used herein, the term "homolog" refers to any VSP protein or VSP-encoding gene that is related to a reference VSP protein or VSP-encoding gene by descent from a common ancestral DNA sequence. The term homolog includes both orthologs and paralogs.

The term "ortholog" refers to VSP homologs in different species that evolved from a common ancestral gene by speciation. Typically, orthologs retain the same or similar function despite differences in their primary structure (mutations).

The term "paralog" refers to VSP homologs in the same species that evolved by genetic duplication of a common ancestral gene. In many cases, paralogs exhibit related (but not always identical functions). To the extent that a particular species has evolved multiple related genes from an ancestral DNA sequence shared with another species, the term ortholog can encompass the term paralog.

Most often, homologs will have functional, structural, or genomic similarities. Techniques are known by which homologs of an enzyme or gene can readily be cloned using genetic probes and PCR. Identity of cloned sequences as homologs can be confirmed using functional assays and/or by genomic mapping of the genes.

VSP proteins are cysteine-rich proteins with multiple CXXC (SEQ ID NO:589) motifs (where X is any amino acid) that have several particular characteristics, including in some VSP the presence of CXC motifs, a *Giardia*-specific Zinc-finger motif, and GGCY (SEQ ID NO:590) motifs (Nash, Mol. Microbiol. 45:585-590 (2002); Adam et al., BMC Genomics 10:424 (2010)). More precisely, VSP proteins are type 1 integral membrane proteins that vary in size from 20 to 200 kDa; possess a variable amino-terminal cysteine-rich region (extracellular domain that represents the host/parasite interface and confers to the protein resistance to proteolytic digestion and low pH), and a conserved carboxy-terminal region that includes a hydrophobic transmembrane region and a short cytosolic tail comprising only 5 amino acids (CRGKA) (SEQ ID NO:591), which are not "seen" by the immune system. Only one VSP protein is expressed at any given time on the surface of each parasite (Nash. Philos. Trans. R. Soc. Lond. B. Biol. Sci. 352:1369-1375 (1997)).

Within the context of the present invention, the terms "variable surface protein," "VSP protein," or "VSP" includes any variable surface protein of the complete repertoire of *Giardia* VSP proteins, notably *Giardia lamblia*. Actually, *Giardia* parasites encodes a repertoire of about 200 genes encoding VSPs for VSP assemblage A (see, e.g., Morrison et al., Science 317:1921-1926 (2010); Adam et al., BMC Genomics 10:424 (2010)), and two reports of Svard's group describing the VSP repertoire of isolates derived from VSP assemblages B and E (Jerlstrom-Hultqvist et al. BMC Genomics 11:543 (2010); Franzen et al. PLoS Pathog. 5(8):c1000560 (2009)). The extracellular domain of a VSP allows the parasite to survive the hostile environment of the upper small intestine. VSPs are very resistant to variable pHs (reactivity to a conformational epitope by a monoclonal antibody directed to a particular VSP remains unaltered between pH 2 and 12), and digestion by trypsin and several other proteases. In addition, VSPs remain attached to the enteric mucosa after the trophozoites have attached to it (Rivero et al., Nat. Med. 16(5):551-7 (2010)). A comprehensive list of VSP proteins can be found at www.ebi.ac.uk/interpro/IEntry?ac=IPR005127.

It must be further noted that polypeptides comprising at least one CXXC (SEQ ID NO:589) motif, wherein C represents a cysteine residue and X any amino acid residue, such as *Giardia* VSPs or VSP-like proteins of other microorganisms may also be generated in vitro by genetic manipulation and produced in heterologous systems. Therefore, chemically- or cell-produced polypeptides, including those with amino acid variations not found in the wild type parasites (for instance variants of *Giardia* VSPs) are encompassed. VSPs may thus be prepared by any well-known procedure in the art, such as solid phase synthesis, liquid phase synthesis or genetic engineering.

VSPs used in the therapeutic compositions of the invention can undergo chemical modifications. Chemical modifications can be aimed at obtaining VSPs with increased protection against enzymatic degradation in vivo, and/or increased capacity to cross membrane barriers, thus increasing their half-lives and maintaining or improving their biological activity. Any chemical modification known in the art can be employed according to the present invention to modify a VSP. Such chemical modifications include but are not limited to:

(a) modifications to the N-terminal and/or C-terminal ends of the VSP proteins such as e.g., N-terminal acylation (preferably acetylation) or desamination, or modification of the C-terminal carboxyl group into an amide or an alcohol group;

(b) modifications at the amide bond between two amino acids: acylation (preferably acetylation) or alkylation (preferably methylation) at the nitrogen atom or the alpha carbon of the amide bond linking two amino acids;

(c) modifications at the alpha carbon of the amide bond linking two amino acids such as, e.g., acylation (preferably acetylation) or alkylation (preferably methylation) at the alpha carbon of the amide bond linking two amino acids.

(d) chirality changes such as, e.g., replacement of one or more naturally occurring amino acids (L enantiomer) with the corresponding D-enantiomers;

(e) retro-inversions in which one or more naturally-occurring amino acids (L-enantiomer) are replaced with the corresponding D-enantiomers, together with an inversion of the amino acid chain (from the C-terminal end to the N-terminal end); and/or (f) azapeptides wherein one or more alpha carbons are replaced with nitrogen atoms.

The terms "protein" and "polypeptide," (e.g., a VSP protein) are used interchangeably to refer to a molecule composed of monomers (amino acids) linearly linked by amide bonds (also known as peptide bonds). Peptides, dipeptides, tripeptides, or oligopeptides are included within the definition of "polypeptide," and the term "polypeptide" can be used instead of, or interchangeably with any of these terms. The term "polypeptide" is also intended to refer to the products of post-expression modifications of the polypeptide, including without limitation glycosylation, acetylation, phosphorylation, amidation, derivatization by known protecting/blocking groups, proteolytic cleavage, or modification by non-naturally occurring amino acids. A polypeptide can be isolated from a natural biological source or produced by recombinant technology, but is not necessarily translated from a designated nucleic acid sequence. A polypeptide can be generated in any manner, including by chemical synthesis.

The terms "protein" or "polypeptide" (e.g., a VSP protein) also include variants which would encompass any polypeptide comprising any natural or genetically engineered polypeptide having at least about 70%, at least about 80%, at least about 90%, at least about 95%, or at least 99% amino acid sequence identity with the sequence of the polypeptide. Variant polypeptides can be generated using genetic engineered, e.g., by insertion, substitution, deletion, or a combination thereof. Substitutions in a protein sequence of the invention can be conservative or non-conservative.

When the term "variant of a protein" applies, according to the present invention, to the *Giardia* VSP or VSP-like protein of other microorganisms, such variant should be able of retaining the ability to attach to cells, particularly to mucosal cells, more particularly to epithelial cells of the GIT and functioning as a therapeutic agent carrier. Variants can be naturally or non-naturally occurring. Non-naturally occurring variants can be produced using art-known mutagenesis techniques. Variant polypeptides can comprise conservative or non-conservative amino acid substitutions, deletions or additions As used here, when the term "fragment" applies to a VSP or VSP-like protein of other microorganism (e.g., in the phrases "a fragment of a VSP" or a "VSP or a fragment thereof") such fragment should encompass any polypeptide comprising at least about 5, 6, 7, 8, 9, 10, 11, 12, 13, 14, 15, 16, 17, 18, 19, 20, 25, 30, 40, 50, 60, 70, 80, 90, 100, 150, 200, 300, 400, or 500 contiguous or discontinuous amino acids of the protein or polypeptide as defined herein, as well as any polypeptide. Such fragment should be capable of retaining the ability to attach to cells, particularly to mucosal cell, more particularly to epithelial cells of the GIT and functioning as a therapeutic agent carrier.

"Derivatives" of polypeptides or proteins of the invention are polypeptides or proteins which have been altered so as to exhibit additional features not found on the native polypeptide or protein, but still display the beneficial properties of the parent polypeptide or protein (e.g., resistance to proteolytic enzyme degradation or binding to gastrointestinal epithelial cells).

An "isolated" polypeptide, protein, or a fragment, variant, or derivative thereof refers to a polypeptide or protein that is not in its natural milieu. No particular level of purification is required. For example, an isolated polypeptide or protein can simply be removed from its native or natural environment. A "recombinant" polypeptide or protein refers to a polypeptide or protein produced via recombinant DNA technology. Recombinantly produced polypeptides and proteins expressed in host cells are considered isolated for the purpose of the invention, as are native or recombinant polypeptides which have been separated, fractionated, or partially or substantially purified by any suitable technique.

A "protein sequence" or "amino acid sequence" means a linear representation of the amino acid constituents in a polypeptide in an amino-terminal to carboxyl-terminal direction in which residues that neighbor each other in the representation are contiguous in the primary structure of the polypeptide.

A "conservative amino acid substitution" is one in which the amino acid residue is replaced with an amino acid residue having a similar side chain Families of amino acid residues having similar side chains have been defined in the art, including basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Thus, if an amino acid in a polypeptide is replaced with another amino acid from the same side chain family, the substitution is considered to be conservative. In another embodiment, a string of amino acids can be conservatively replaced with a structurally similar string that differs in order and/or composition of side chain family members.

The term "percent sequence identity" between two polynucleotide or polypeptide sequences refers to the number of identical matched positions shared by the sequences over a comparison window, taking into account additions or deletions (i.e., gaps) that must be introduced for optimal alignment of the two sequences. A matched position is any position where an identical nucleotide or amino acid is presented in both the target and reference sequence. Gaps presented in the target sequence are not counted since gaps are not nucleotides or amino acids. Likewise, gaps presented in the reference sequence are not counted since target sequence nucleotides or amino acids are counted, not nucleotides or amino acids from the reference sequence.

The percentage of sequence identity is calculated by determining the number of positions at which the identical amino-acid residue or nucleic acid base occurs in both sequences to yield the number of matched positions, dividing the number of matched positions by the total number of positions in the window of comparison and multiplying the result by 100 to yield the percentage of sequence identity. The comparison of sequences and determination of percent sequence identity between two sequences may be accomplished using readily available software both for online use and for download. Suitable software programs are available from various sources, and for alignment of both protein and nucleotide sequences. One suitable program to determine percent sequence identity is bl2seq, part of the BLAST suite of program available from the U.S. government's National Center for Biotechnology Information BLAST web site (blast.ncbi.nlm.nih.gov). Bl2seq performs a comparison between two sequences using either the BLASTN or BLASTP algorithm. BLASTN is used to compare nucleic acid sequences, while BLASTP is used to compare amino acid sequences. Other suitable programs are, e.g., Needle, Stretcher, Water, or Matcher, part of the EMBOSS suite of bioinformatics programs and also available from the European Bioinformatics Institute (EBI) at www.ebi.ac.uk/Tools/psa.

Different regions within a single polynucleotide or polypeptide target sequence that aligns with a polynucleotide or polypeptide reference sequence can each have their own percent sequence identity. It is noted that the percent sequence identity value is rounded to the nearest tenth. For example, 80.11, 80.12, 80.13, and 80.14 are rounded down to 80.1, while 80.15, 80.16, 80.17, 80.18, and 80.19 are rounded up to 80.2. It also is noted that the length value will always be an integer.

One skilled in the art will appreciate that the generation of a sequence alignment for the calculation of a percent sequence identity is not limited to binary sequence-sequence comparisons exclusively driven by primary sequence data. Sequence alignments can be derived from multiple sequence alignments. One suitable program to generate multiple sequence alignments is ClustalW2, available from www.clustal.org. Another suitable program is MUSCLE, available from www.drive5.com/muscle/. ClustalW2 and MUSCLE are alternatively available, e.g., from the EBI.

It will also be appreciated that sequence alignments can be generated by integrating sequence data with data from heterogeneous sources such as structural data (e.g., crystallographic protein structures), functional data (e.g., location of mutations), or phylogenetic data. A suitable program that integrates heterogeneous data to generate a multiple sequence alignment is T-Coffee, available at www.tcoffee.org, and alternatively available, e.g., from the EBI. It will also be appreciated that the final alignment used to calculated percent sequence identity may be curated either automatically or manually.

The terms "heterologous moiety" mean that a polynucleotide, polypeptide, non-peptidic polymer or other moiety is derived from a distinct entity from that of the entity to which it is being compared. For instance, a heterologous polypeptide can be synthetic, or derived from a different species, different cell type of an individual, or the same or different type of cell of distinct individuals. In one aspect, a heterologous moiety can be a polypeptide fused to another polypeptide to produce a fusion polypeptide or protein. In another aspect, a heterologous moiety can be a non-polypeptide. In some embodiments, the VSP carrier comprises a heterologous moiety, e.g., a His6 tag for protein purification. In other embodiments, therapeutic agents that are combined with VSP carriers provided herein can be conjugated or fused (recombinantly, or using protein synthesis or chemical conjugation methods) to at least one heterologous moiety, e.g., polyethylene glycol (PEG), to improve a pharmacokinetic and/or pharmacodynamics property (e.g., in vivo half-life). Heterologous moieties capable of increasing the in vivo half-life of therapeutic agents are known in the art.

The term "increased" with respect to a functional characteristic of a therapeutic agent such as resistance to degradation caused by high or low pH, resistance to enzymatic degradation (e.g., proteolytic degradation), or binding to target cells (e.g., gastrointestinal epithelial cells) is used to indicate that the relevant functional characteristic is increased relative to that of a reference (for example the therapeutic agent administered in the absence of a VSP carrier), as determined under comparable conditions.

In some embodiments, the increase in the functional characteristic of the therapeutic agent (e.g., resistance to enzymatic degradation in the GIT) is, e.g., at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% higher relative to a reference (for example resistance to enzymatic degradation of the therapeutic agent, e.g., insulin, in the GIT in the absence of a VSP carrier), as determined under comparable conditions.

In some embodiments, the increase in the functional characteristic of the therapeutic agent (e.g., resistance to enzymatic degradation in the GIT) is, e.g., an at least about 2-fold, at least about 3-fold, at least about 4-fold, at least about 5-fold, at least about 6-fold, at least about 7-fold, at least about 8-fold, at least about 9-fold, at least about 10-fold, at least about 20-fold, at least about 30-fold, at least about 40-fold, at least about 50-fold, at least about 60-fold, at least about 70-fold, at least about 80-fold, at least about 90-fold, or at least about 100-fold increase relative to a reference (for example when compared to the resistance to enzymatic degradation of the therapeutic agent, e.g., insulin, in the GIT in the absence of a VSP carrier), as determined under comparable conditions.

The term "decreased" with respect to a functional characteristic of a therapeutic agent such as resistance to degradation caused by high or low pH, resistance to enzymatic degradation (e.g., proteolytic degradation), or binding to target cells (e.g., gastrointestinal epithelial cells) is used to indicate that the relevant functional characteristic is decreased relative to that of a reference (for example the therapeutic agent administered in the absence of a VSP carrier), as determined under comparable conditions.

In some embodiments, the decrease in the functional characteristic of the therapeutic agent (e.g., resistance to enzymatic degradation in the GIT) is, e.g., at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 96%, at least about 97%, at least about 98%, or at least about 99% lower relative to a reference (for example resistance to enzymatic degradation of the therapeutic agent, e.g., insulin, in the GIT in the presence of a VSP carrier), as determined under comparable conditions.

In some embodiments, the decrease in the functional characteristic of the therapeutic agent (e.g., resistance to enzymatic degradation in the GIT) is, e.g., at least about 2-fold, at least about 3-fold, at least about 4-fold, at least about 5-fold, at least about 6-fold, at least about 7-fold, at least about 8-fold, at least about 9-fold, at least about 10-fold, at least about 20-fold, at least about 30-fold, at least about 40-fold, at least about 50-fold, at least about 60-fold, at least about 70-fold, at least about 80-fold, at least about 90-fold, or at least about 100-fold lower relative to a reference (for example when compared to the resistance to enzymatic degradation of the therapeutic agent, e.g., insulin, in the GIT in the presence of a VSP carrier), as determined under comparable conditions.

The term "polynucleotide" or "nucleotide" is intended to encompass a singular nucleic acid as well as plural nucleic acids, and refers to an isolated nucleic acid molecule or construct, e.g., messenger RNA (mRNA) or plasmid DNA (pDNA). In certain embodiments, a polynucleotide comprises a conventional phosphodiester bond or a non-conventional bond (e.g., an amide bond, such as found in peptide nucleic acids (PNA)).

The term "nucleic acid" refers to any one or more nucleic acid segments, e.g., DNA or RNA fragments, present in a polynucleotide. By "isolated" nucleic acid or polynucleotide is intended a nucleic acid molecule, DNA or RNA, which has been removed from its native environment. For example, a recombinant polynucleotide encoding a VSP polypeptide contained in a vector is considered isolated for the purposes of the present invention. Further examples of an isolated polynucleotide include recombinant polynucleotides maintained in heterologous host cells or purified (partially or substantially) from other polynucleotides in a solution. Isolated RNA molecules include in vivo or in vitro RNA transcripts of polynucleotides of the present invention. Isolated polynucleotides or nucleic acids according to the present invention further include such molecules produced synthetically. In addition, a polynucleotide or a nucleic acid can include regulatory elements such as promoters, enhancers, ribosome binding sites, or transcription termination signals.

As used herein, a "coding region" or "coding sequence" is a portion of polynucleotide which consists of codons translatable into amino acids. Although a "stop codon" (TAG, TGA, or TAA) is typically not translated into an amino acid, it may be considered to be part of a coding region, but any flanking sequences, for example promoters, ribosome binding sites, transcriptional terminators, introns, and the like, are not part of a coding region. The boundaries of a coding region are typically determined by a start codon at the 5' terminus, encoding the amino terminus of the resultant polypeptide, and a translation stop codon at the 3' terminus, encoding the carboxyl terminus of the resulting polypeptide. Two or more coding regions of the present invention can be present in a single polynucleotide construct, e.g., on a single vector, or in separate polynucleotide constructs, e.g., on separate (different) vectors. It follows, then, that a single vector can contain just a single coding region, or comprise two or more coding regions, e.g., a single vector can separately encode a binding domain-A and a binding domain-B as described below. In addition, a vector, polynucleotide, or nucleic acid of the invention can encode heterologous coding regions, either fused or unfused to a nucleic acid encoding a binding domain of the invention. Heterologous coding regions include without limitation specialized elements or motifs, such as a secretory signal peptide or a heterologous moiety (e.g., a His6 tag).

Certain proteins secreted by eukaryotic cells are associated with a secretory signal peptide which is cleaved from the mature protein once export of the growing protein chain across the rough endoplasmic reticulum has been initiated. Those of ordinary skill in the art are aware that signal peptides are generally fused to the N-terminus of the polypeptide, and are cleaved from the complete or "full-length" polypeptide to produce a secreted or "mature" form of the polypeptide. In certain embodiments, a native signal peptide is used, or a functional derivative of that sequence that retains the ability to direct the secretion of the polypeptide that is operably associated with it. Alternatively, a heterologous signal peptide, e.g., a human tissue plasminogen activator (TPA) or mouse β-glucuronidase signal peptide, or a functional derivative thereof, can be used.

As used herein, the term "host cell" refers to a cell or a population of cells harboring or capable of harboring a recombinant nucleic acid. Host cells can be a prokaryotic cells (e.g., *E. coli*), or alternatively, the host cells can be eukaryotic, for example, fungal cells (e.g., yeast cells such as *Saccharomyces cerivisiae, Pichia pastoris*, or *Schizosaccharomyces pombe*), and various animal cells, such as insect cells (e.g., Sf-9) or mammalian cells (e.g., HEK293F, CHO, COS-7, NIH-3T3).

The term "therapeutic agent" refers to any therapeutically active substance that is delivered to a subject, e.g., orally, to produce a desired beneficial effect such as preventing, inhibiting, or arresting the symptoms and/or progression of a disease or condition. In some embodiments, a therapeutic agent can be preformulated, e.g., as a microcapsule, microsphere, microbubble, liposome, nisome, emulsion, dispersion, etc., before it is combined with the VSP carrier. Also included in the definition of therapeutic agent are diagnostically active agents and imaging agents such as dyes or fluorescent markers.

As used herein, the term “pharmaceutically acceptable” means approved by a regulatory agency of U.S. or E.U. or other government or listed in the U.S. Pharmacopeia or other generally recognized pharmacopeia for use in humans. Hence, the term “pharmaceutically acceptable” refers to those properties and/or substances that are acceptable to a patient (e.g., a human patient) from a toxicological and/or safety point of view.

The terms “pharmaceutically acceptable excipient” and “pharmaceutically acceptable carrier” refer to excipients and carriers used in pharmaceutical compositions which do not have a significant detrimental impact on the treated host and which retain the therapeutic properties of the therapeutic agent with which it they are administered. One exemplary physiologically acceptable carrier is physiological saline. Other physiologically acceptable carriers and their formulations are known to one skilled in the art and are described, for example, in Remington’s Pharmaceutical Sciences, ($18^{t5}$ edition), ed. A. Gennaro, 1990, Mack Publishing Company, Easton, Pa., incorporated herein by reference.

The phrase “effective amount” as used herein refers to that amount of a therapeutic composition of the invention, comprising a combination of a therapeutic agent with a VSP carrier, or a pharmaceutical composition comprising such therapeutic composition which is effective for producing a desired effect, at a reasonable benefit/risk ratio applicable to any medical treatment. For example, an “effective amount” is an amount effective to reduce or lessen at least one symptom of the disease or disorder being treated or to reduce or delay onset of one or more clinical markers or symptoms associated with the disease or disorder, or to modify or reverse the disease process.

The terms “treat” or “treatment” as used herein refer to both therapeutic treatment and prophylactic or preventative measures, wherein the object is to prevent or slow down (lessen) an undesired physiological change or disorder in a subject, such as the progression of an hormone deficiency-related disease or condition. Beneficial or desired clinical results include, but are not limited to, alleviation of symptoms, diminishment of extent of disease, stabilized (i.e., not worsening) state of disease, delay or slowing of disease progression, amelioration or palliation of the disease state, and remission (whether partial or total), whether detectable or undetectable.

The term “treatment” also means prolonging survival as compared to expected survival if not receiving treatment. Those in need of treatment include those already with the condition or disorder as well as those prone to have the condition or disorder or those in which the condition or disorder is to be prevented.

The term "administering," as used herein, means to give a therapeutic composition of the invention comprising a therapeutic agent combined with a VSP carrier, or pharmaceutical composition comprising the therapeutic composition of the invention, to a subject (e.g., human subject) in need thereof via a pharmaceutically acceptable route of administration. In some embodiments, the route of administration is oral or mucosal. In other embodiments, the route of administration is selected from subcutaneous, intramuscular, nasal, intravenous, and pulmonary administration. A VSP carrier can be administered as part of a pharmaceutical composition comprising at least one therapeutic agent and at least one pharmaceutically acceptable excipient.

The terms "subject" and "patient" are used interchangeably and refer to any individual, patient or animal, in particularly a mammalian subject, for whom diagnosis, prognosis, or therapy is desired. Mammalian subjects include humans, domestic animals, farm animals, and zoo, sports, or pet animals such as dogs, cats, guinea pigs, rabbits, rats, mice, horses, cattle, cows, etc.

Introduction

This disclosure provides therapeutic compositions comprising a VSP carrier and a therapeutic agent. VSP carriers are polypeptides such as variant-specific surface proteins (VSPs) of the intestinal parasite *Giardia lamblia* and VSP-like proteins from other organisms which can bind to therapeutic agents, e.g., bioactive peptides, and effectively deliver such therapeutic agents by the oral or mucosal route. To determine whether VSPs, due to their resistance to degradation by acidic pH, resistance to proteolytic degradation, and adherence to the intestinal mucosa, can effectively be combined with therapeutic agents (e.g., bioactive peptide) and be used as carriers to transport therapeutic agents through the gastro intestinal tract (GIT), we have used three bioactive peptides, insulin, glucagon, and human growth hormone, as prototype therapeutic agents to be delivered by the oral route.

The results disclosed herein in the Examples section indicate that VSP carriers can be used to effectively deliver therapeutic agents orally, or by other delivery routes (e.g., mucosal administration) where proteolytic degradation and/or exposure to low pH could affect the integrity of the therapeutic agent.

The term "VSP carrier" as used herein refers to a VSP protein (e.g., a *Giardia* VSP, a VSP-like protein, a VSP or VSP-like protein fragment, a VSP or VSP-like protein variant, a VSP or VSP-like protein derivative, or a combination of two or more of said VSP polypeptides) which can bind to at least one therapeutic agent. In certain embodiments, the at least one therapeutic agent is not a vaccine immunogen.

The VSP carriers of the invention are not covalently bound to the therapeutic agents via peptidic bonds. Thus, the term "bound" and its grammatical variants (e.g., "bind," "binds," "binding," etc.) when applied to the interaction between a VSP carrier and a therapeutic agent refers to (i) covalent non-peptide binding (e.g., binding via a disulphide bond) or (ii) non-covalent binding, but not to peptide-bond formation between the VSP carrier and a therapeutic agent.

Non-limiting examples of non-covalent binding between a VSP carrier and a therapeutic agent include an ionic bond (e.g., cation-pi bond or salt bond), a metal bond, an hydrogen bond (e.g., dihydrogen bond, dihydrogen complex, low-barrier hydrogen bond, or symmetric hydrogen bond), van der Waals force, London dispersion force, a mechanical bond, a halogen bond, aurophilicity, intercalation, stacking, entropic force, or chemical polarity.

The term "bound" also refers to the enclosement, or partial enclosement of a therapeutic agent (e.g., a bioactive peptide such as insulin) by a molecular structure that comprises a VSP carrier. In some embodiments, the term "bound" refers to the interaction (covalent or non-covalent) of a VSP carrier with a macromolecular structure in which a therapeutic agent is enclosed. In this respect, the therapeutic agent can be enclosed or packaged, e.g., in a lipid bilayer, liposome, nanoparticle, nanotube, nanobubble, micelle, nanosphere, nanoshell, nanorod, chemical cage, nanohorn, quantum dot, nanocluster, microbubble, dendrimer, aquasome, lipopolyplex, nanoemulsion, or a combination thereof. The term "bound" also includes binding of a VSP carrier to a lipid bilayer or insertion of a VSP carrier into a lipid bilayer which either comprises the therapeutic agent (e.g., a liposoluble drug inserted in the bilayer's hydrophobic core) or encloses the therapeutic agent (e.g., the lipid bilayer is part of a liposome in which the therapeutic agent is packaged).

In some embodiments, the VSP carrier comprises a heterogous moiety genetically fused to a hydrophobic peptide that anchors the VSP carrier the bilayer. In other embodiments, a heterologous moiety that anchors the VSP carrier to the bilayer (e.g., a hydrophobic peptide or a lipid anchor) can be chemically conjugated to the VSP carrier. In some embodiments, the VSP carrier can be genetically fused or conjugated to a heterologous moiety by a linker. The term "linker" refers to a molecular entity that covalently links a VSP carrier and a heterologous moiety. The linker can comprises, for example, a thiol group, an alkyl group, a glycol group, or a peptide group. Linkers include cross-linking molecules. See, e.g., Int. Pat. Publ. No. WO 2004/009116 which is incorporated herein by reference in its entirety.

In some embodiments, the VSP carrier is bound to the therapeutic agent by forming a "virus-like particle" (VLP) which comprises the therapeutic agent (either on the surface of the VLP or encapsulated in the VLP). As used herein, the term "virus-like particle" or "VLP" refers to a structure resembling a virus particle that displays a *Giardia* VSP or a fragment thereof at its surface. A virus-like particle in accordance with the present invention is non-replicative since it lacks all or part of a viral genome, typically and preferably lacking all or part of the replicative and infectious components of a viral genome. The term "non-replicative" as used herein refers to being incapable of replicating the genome comprised or not in the VLP.

As used herein, the term "combine" (and grammatical variants such as "combined" or "combining") refers to the process of admixing two or more components (e.g., a VSP carrier and a therapeutic agent) such that contact between the components occur and such contact allows the binding of the two or more components.

In some specific embodiments, a therapeutic agent (e.g., a bioactive peptide such as IL-2) can be genetically fused to a VSP protein (see, e.g., preliminary experiments disclosed in the first paragraph of Example 9). In specific embodiments, the therapeutic agent is a bioactive peptide (e.g., insulin, glucagon, growth hormone) in a nanoparticle form which is chemically conjugated to a VSP. In some embodiments, a therapeutic agent (e.g., a bioactive peptide) is chemically conjugated to a VSP without any linker interposed between the therapeutic agent and the linker. In some embodiments, a therapeutic agent (e.g., a bioactive peptide) is chemically conjugated to a VSP with at least one linker interposed between the therapeutic agent and the VSP.

In some embodiments, a VSP carrier can be chemically conjugated with more than one therapeutic agent (e.g., more than one bioactive peptide). In some embodiments, two or more VSP carriers can be chemically conjugated with one therapeutic agent (e.g., a bioactive peptide). In other embodiments, two or more than two VSP carriers can be chemically conjugated with more than one therapeutic agent (e.g., more than one bioactive peptide). In some embodiments, a therapeutic agent is biologically active while genetically fused or chemically conjugated to a VSP carrier. In other embodiments, the therapeutic agent (e.g., a bioactive peptide) is inactive or only partially active while genetically fused or chemically conjugated to a VSP carrier, in which case, chemical and/or enzymatic cleavage can be required to release the active (or a more active) form of the therapeutic agent. Conversely, in some embodiments, the therapeutic agent (e.g., a bioactive peptide) is active while genetically fused or chemically conjugated to a VSP carrier, and chemical and/or enzymatic cleavage can be used to release the active form of the therapeutic agent from the VSP carrier in order to inactivate the therapeutic agent. Thus, a therapeutic agent (e.g., a bioactive peptide) could be protected by the VSP carrier while in a part of the GIT (e.g., the stomach), and degraded or inactivated after passage to a different part of the GIT by the different conditions prevalent in that portion of the GIT (e.g., different pH or specific enzymes).

In some embodiments, a therapeutic agent (e.g., a bioactive peptide) and a VSP carrier can be genetically fused or chemically conjugated by a peptide linker or other type of linker that can be cleaved (e.g., chemically or by a protease) such as the active form of the therapeutic peptide is released from the VSP carrier. In some embodiments, a therapeutic agent (e.g., a bioactive peptide) and a VSP carrier can be genetically fused or chemically conjugated by a peptide linker or other type of linker that can be cleaved (e.g., chemically or by a protease) such as the inactive form of the therapeutic agent is released from the VSP carrier.

In some embodiments, a therapeutic agent (e.g., a bioactive peptide) and a VSP carrier (bound, genetically fused, or chemically conjugated) can be bound, genetically fused, or chemically conjugated with another molecule to form a bivalent molecule (for example, both the VSP carrier and the therapeutic agent being genetically fused to the carboxy terminus of the beta chain of C4b-binding protein (C4PB)).

VSP Carriers from *Giardia* VSPs

In some embodiments, the VSP carrier comprises a VSP sequence chosen among the complete repertoire of VSPs which are encoded at the DNA level in the genome of the *Giardia* parasite. This repertoire is composed of about 200 homologous VSP-encoding genes (vsps), which varies in different *Giardia* isolates (see, Adam et al., BMC Genomics 11:424 (2010)). It should be further noted that variants of the *Giardia* VSPs, fragments, and derivatives can also be used as VSP carriers according to the invention. A representative, non-limiting list of proteins that can be used as VSP carriers is presented in TABLE 1.

TABLE 1

Exemplary list of VSP and VSP-like proteins that can be used as VSP carriers.

| SEQ ID NO | UNIPROT IDENTIFIER | SPECIES |
| --- | --- | --- |
| 7 | A0BQN4_PARTE | *Paramecium tetraurelia* |
| 8 | A0BR77_PARTE | *Paramecium tetraurelia* |
| 9 | A0D0W7_PARTE | *Paramecium tetraurelia* |
| 10 | A2E569_TRIVA | *Trichomonas vaginalis* |
| 11 | A2EKF7_TRIVA | *Trichomonas vaginalis* |

TABLE 1-continued

Exemplary list of VSP and VSP-like proteins that can be used as VSP carriers.

| SEQ ID NO | UNIPROT IDENTIFIER | SPECIES |
| --- | --- | --- |
| 12 | A6YSN6_GIAIN | *Giardia intestinalis* |
| 13 | A7SVH3_NEMVE | *Nematostella vectensis* |
| 14 | A8B1N7_GIAIC | *Giardia intestinalis* |
| 15 | A8B1Y1_GIAIC | *Giardia intestinalis* |
| 16 | A8B2D7_GIAIC | *Giardia intestinalis* |
| 17 | A8B2E6_GIAIC | *Giardia intestinalis* |
| 18 | A8B2P0_GIAIC | *Giardia intestinalis* |
| 19 | A8B2X6_GIAIC | *Giardia intestinalis* |
| 20 | A8B2Y3_GIAIC | *Giardia intestinalis* |
| 21 | A8B3P1_GIAIC | *Giardia intestinalis* |
| 22 | A8B3R3_GIAIC | *Giardia intestinalis* |
| 23 | A8B3V9_GIAIC | *Giardia intestinalis* |
| 24 | A8B497_GIAIC | *Giardia intestinalis* |
| 25 | A8B4C6_GIAIC | *Giardia intestinalis* |
| 26 | A8B4J7_GIAIC | *Giardia intestinalis* |
| 27 | A8B4K3_GIAIC | *Giardia intestinalis* |
| 28 | A8B4K7_GIAIC | *Giardia intestinalis* |
| 29 | A8B4P3_GIAIC | *Giardia intestinalis* |
| 30 | A8B4S6_GIAIC | *Giardia intestinalis* |
| 31 | A8B4Y0_GIAIC | *Giardia intestinalis* |
| 32 | A8B4Y3_GIAIC | *Giardia intestinalis* |
| 33 | A8B582_GIAIC | *Giardia intestinalis* |
| 34 | A8B5B4_GIAIC | *Giardia intestinalis* |
| 35 | A8B5M7_GIAIC | *Giardia intestinalis* |
| 36 | A8B5M8_GIAIC | *Giardia intestinalis* |
| 37 | A8B5P6_GIAIC | *Giardia intestinalis* |
| 38 | A8B5Q2_GIAIC | *Giardia intestinalis* |
| 39 | A8B5U7_GIAIC | *Giardia intestinalis* |
| 40 | A8B5U8_GIAIC | *Giardia intestinalis* |
| 41 | A8B6C8_GIAIC | *Giardia intestinalis* |
| 42 | A8B6F0_GIAIC | *Giardia intestinalis* |
| 43 | A8B6G2_GIAIC | *Giardia intestinalis* |
| 44 | A8B6J1_GIAIC | *Giardia intestinalis* |
| 45 | A8B6V3_GIAIC | *Giardia intestinalis* |
| 46 | A8B728_GIAIC | *Giardia intestinalis* |
| 47 | A8B7F5_GIAIC | *Giardia intestinalis* |
| 48 | A8B7F8_GIAIC | *Giardia intestinalis* |
| 49 | A8B7K8_GIAIC | *Giardia intestinalis* |
| 50 | A8B7T7_GIAIC | *Giardia intestinalis* |
| 51 | A8B838_GIAIC | *Giardia intestinalis* |
| 52 | A8B8E0_GIAIC | *Giardia intestinalis* |
| 53 | A8B8R6_GIAIC | *Giardia intestinalis* |
| 54 | A8B8Y3_GIAIC | *Giardia intestinalis* |
| 55 | A8B9G0_GIAIC | *Giardia intestinalis* |
| 56 | A8B9Q8_GIAIC | *Giardia intestinalis* |
| 57 | A8B9R0_GIAIC | *Giardia intestinalis* |
| 58 | A8BA10_GIAIC | *Giardia intestinalis* |
| 59 | A8BA87_GIAIC | *Giardia intestinalis* |
| 60 | A8BAG1_GIAIC | *Giardia intestinalis* |
| 61 | A8BAG4_GIAIC | *Giardia intestinalis* |
| 62 | A8BAI1_GIAIC | *Giardia intestinalis* |
| 63 | A8BAX4_GIAIC | *Giardia intestinalis* |
| 64 | A8BB06_GIAIC | *Giardia intestinalis* |
| 65 | A8BB29_GIAIC | *Giardia intestinalis* |
| 66 | A8BB81_GIAIC | *Giardia intestinalis* |
| 67 | A8BBE8_GIAIC | *Giardia intestinalis* |
| 68 | A8BBH5_GIAIC | *Giardia intestinalis* |
| 69 | A8BBP7_GIAIC | *Giardia intestinalis* |
| 70 | A8BBQ0_GIAIC | *Giardia intestinalis* |
| 71 | A8BBQ1_GIAIC | *Giardia intestinalis* |
| 72 | A8BBR6_GIAIC | *Giardia intestinalis* |
| 73 | A8BBX7_GIAIC | *Giardia intestinalis* |
| 74 | A8BC24_GIAIC | *Giardia intestinalis* |
| 75 | A8BC41_GIAIC | *Giardia intestinalis* |
| 76 | A8BCN1_GIAIC | *Giardia intestinalis* |
| 77 | A8BCU7_GIAIC | *Giardia intestinalis* |
| 78 | A8BCV1_GIAIC | *Giardia intestinalis* |
| 79 | A8BCV5_GIAIC | *Giardia intestinalis* |
| 80 | A8BCV8_GIAIC | *Giardia intestinalis* |
| 81 | A8BCW0_GIAIC | *Giardia intestinalis* |
| 82 | A8BCW5_GIAIC | *Giardia intestinalis* |
| 83 | A8BD73_GIAIC | *Giardia intestinalis* |
| 84 | A8BD76_GIAIC | *Giardia intestinalis* |
| 85 | A8BDC4_GIAIC | *Giardia intestinalis* |

TABLE 1-continued

Exemplary list of VSP and VSP-like proteins that can be used as VSP carriers.

| SEQ ID NO | UNIPROT IDENTIFIER | SPECIES |
|---|---|---|
| 86 | A8BDH4_GIAIC | Giardia intestinalis |
| 87 | A8BDM0_GIAIC | Giardia intestinalis |
| 88 | A8BDP5_GIAIC | Giardia intestinalis |
| 89 | A8BEA2_GIAIC | Giardia intestinalis |
| 90 | A8BEA7_GIAIC | Giardia intestinalis |
| 91 | A8BEJ8_GIAIC | Giardia intestinalis |
| 92 | A8BEQ4_GIAIC | Giardia intestinalis |
| 93 | A8BET9_GIAIC | Giardia intestinalis |
| 94 | A8BEU2_GIAIC | Giardia intestinalis |
| 95 | A8BEV3_GIAIC | Giardia intestinalis |
| 96 | A8BFA0_GIAIC | Giardia intestinalis |
| 97 | A8BFC1_GIAIC | Giardia intestinalis |
| 98 | A8BFJ7_GIAIC | Giardia intestinalis |
| 99 | A8BFK4_GIAIC | Giardia intestinalis |
| 100 | A8BFY9_GIAIC | Giardia intestinalis |
| 101 | A8BFZ3_GIAIC | Giardia intestinalis |
| 102 | A8BG61_GIAIC | Giardia intestinalis |
| 103 | A8BGA3_GIAIC | Giardia intestinalis |
| 104 | A8BH77_GIAIC | Giardia intestinalis |
| 105 | A8BH92_GIAIC | Giardia intestinalis |
| 106 | A8BHI3_GIAIC | Giardia intestinalis |
| 107 | A8BHL4_GIAIC | Giardia intestinalis |
| 108 | A8BHY9_GIAIC | Giardia intestinalis |
| 109 | A8BJ28_GIAIC | Giardia intestinalis |
| 110 | A8BJM0_GIAIC | Giardia intestinalis |
| 111 | A8BJT8_GIAIC | Giardia intestinalis |
| 112 | A8BJU0_GIAIC | Giardia intestinalis |
| 113 | A8BJU2_GIAIC | Giardia intestinalis |
| 114 | A8BK37_GIAIC | Giardia intestinalis |
| 115 | A8BK84_GIAIC | Giardia intestinalis |
| 116 | A8BLI8_GIAIC | Giardia intestinalis |
| 117 | A8BLR0_GIAIC | Giardia intestinalis |
| 118 | A8BLZ5_GIAIC | Giardia intestinalis |
| 119 | A8BM49_GIAIC | Giardia intestinalis |
| 120 | A8BM52_GIAIC | Giardia intestinalis |
| 121 | A8BM73_GIAIC | Giardia intestinalis |
| 122 | A8BME9_GIAIC | Giardia intestinalis |
| 123 | A8BMY2_GIAIC | Giardia intestinalis |
| 124 | A8BN71_GIAIC | Giardia intestinalis |
| 125 | A8BNR0_GIAIC | Giardia intestinalis |
| 126 | A8BNR1_GIAIC | Giardia intestinalis |
| 127 | A8BNR4_GIAIC | Giardia intestinalis |
| 128 | A8BNZ3_GIAIC | Giardia intestinalis |
| 129 | A8BNZ4_GIAIC | Giardia intestinalis |
| 130 | A8BP21_GIAIC | Giardia intestinalis |
| 131 | A8BPL3_GIAIC | Giardia intestinalis |
| 132 | A8BPN5_GIAIC | Giardia intestinalis |
| 133 | A8BPN6_GIAIC | Giardia intestinalis |
| 134 | A8BPP1_GIAIC | Giardia intestinalis |
| 135 | A8BPP4_GIAIC | Giardia intestinalis |
| 136 | A8BPP7_GIAIC | Giardia intestinalis |
| 137 | A8BQ05_GIAIC | Giardia intestinalis |
| 138 | A8BQ57_GIAIC | Giardia intestinalis |
| 139 | A8BQ73_GIAIC | Giardia intestinalis |
| 140 | A8BQD0_GIAIC | Giardia intestinalis |
| 141 | A8BQD1_GIAIC | Giardia intestinalis |
| 142 | A8BQM2_GIAIC | Giardia intestinalis |
| 143 | A8BQM3_GIAIC | Giardia intestinalis |
| 144 | A8BQN8_GIAIC | Giardia intestinalis |
| 145 | A8BQX2_GIAIC | Giardia intestinalis |
| 146 | A8BQX8_GIAIC | Giardia intestinalis |
| 147 | A8BRF5_GIAIC | Giardia intestinalis |
| 148 | A8BRK4_GIAIC | Giardia intestinalis |
| 149 | A8BRR2_GIAIC | Giardia intestinalis |
| 150 | A8BRR9_GIAIC | Giardia intestinalis |
| 151 | A8BRS4_GIAIC | Giardia intestinalis |
| 152 | A8BRY1_GIAIC | Giardia intestinalis |
| 153 | A8BS16_GIAIC | Giardia intestinalis |
| 154 | A8BS49_GIAIC | Giardia intestinalis |
| 155 | A8BS56_GIAIC | Giardia intestinalis |
|

TABLE 1-continued

Exemplary list of VSP and VSP-like proteins that can be used as VSP carriers.

| SEQ ID NO | UNIPROT IDENTIFIER | SPECIES |
|---|---|---|
| 234 | C6LNL8_GIAIB | Giardia intestinalis |
| 235 | C6LNP8_GIAIB | Giardia intestinalis |
| 236 | C6LNT8_GIAIB | Giardia intestinalis |
| 237 | C6LPA7_GIAIB | Giardia intestinalis |
| 238 | C6LPF5_GIAIB | Giardia intestinalis |
| 239 | C6LPK7_GIAIB | Giardia intestinalis |
| 240 | C6LPM5_GIAIB | Giardia intestinalis |
| 241 | C6LQL2_GIAIB | Giardia intestinalis |
| 242 | C6LR62_GIAIB | Giardia intestinalis |
| 243 | C6LR84_GIAIB | Giardia intestinalis |
| 244 | C6LRD7_GIAIB | Giardia intestinalis |
| 245 | C6LSQ1_GIAIB | Giardia intestinalis |
| 246 | C6LT09_GIAIB | Giardia intestinalis |
| 247 | C6LT91_GIAIB | Giardia intestinalis |
| 248 | C6LTI3_GIAIB | Giardia intestinalis |
| 249 | C6LTI4_GIAIB | Giardia intestinalis |
| 250 | C6LUA9_GIAIB | Giardia intestinalis |
| 251 | C6LUN4_GIAIB | Giardia intestinalis |
| 252 | C6LV02_GIAIB | Giardia intestinalis |
| 253 | C6LV68_GIAIB | Giardia intestinalis |
| 254 | C6LVB6_GIAIB | Giardia intestinalis |
| 255 | C6LVG2_GIAIB | Giardia intestinalis |
| 256 | C6LVI0_GIAIB | Giardia intestinalis |
| 257 | C6LVL2_GIAIB | Giardia intestinalis |
| 258 | C6LVZ6_GIAIB | Giardia intestinalis |
| 259 | C6LW79_GIAIB | Giardia intestinalis |
| 260 | C6LW95_GIAIB | Giardia intestinalis |
| 261 | C6LW96_GIAIB | Giardia intestinalis |
| 262 | C6LWD6_GIAIB | Giardia intestinalis |
| 263 | C6LWL1_GIAIB | Giardia intestinalis |
| 264 | C6LWM7_GIAIB | Giardia intestinalis |
| 265 | C6LWN2_GIAIB | Giardia intestinalis |
| 266 | C6LWN3_GIAIB | Giardia intestinalis |
| 267 | C6LWN4_GIAIB | Giardia intestinalis |
| 268 | C6LWQ8_GIAIB | Giardia intestinalis |
| 269 | C6LX19_GIAIB | Giardia intestinalis |
| 270 | C6LX20_GIAIB | Giardia intestinalis |
| 271 | C6LXE3_GIAIB | Giardia intestinalis |
| 272 | C6LXG6_GIAIB | Giardia intestinalis |
| 273 | C6LXK0_GIAIB | Giardia intestinalis |
| 274 | C6LYE5_GIAIB | Giardia intestinalis |
| 275 | C6M071_GIAIB | Giardia intestinalis |
| 276 | C6M0C1_GIAIB | Giardia intestinalis |
|

TABLE 1-continued

Exemplary list of VSP and VSP-like proteins that can be used as VSP carriers.

| SEQ ID NO | UNIPROT IDENTIFIER | SPECIES |
|---|---|---|
| 382 | E1F5N4_GIAIA | Giardia intestinalis |
| 383 | E1F5N5_GIAIA | Giardia intestinalis |
| 384 | E1F5Q7_GIAIA | Giardia intestinalis |
| 385 | E1F5Q8_GIAIA | Giardia intestinalis |
| 386 | E1F5R1_GIAIA | Giardia intestinalis |
| 387 | E1F5S2_GIAIA | Giardia intestinalis |
| 388 | E1F5W0_GIAIA | Giardia intestinalis |
| 389 | E1F5W1_GIAIA | Giardia intestinalis |
| 390 | E1F5X3_GIAIA | Giardia intestinalis |
| 391 | E1F5Y9_GIAIA | Giardia intestinalis |
| 392 | E1F5Z9_GIAIA | Giardia intestinalis |
| 393 | E1F623_GIAIA | Giardia intestinalis |
| 394 | E1F663_GIAIA | Giardia intestinalis |
| 395 | E1F667_GIAIA | Giardia intestinalis |
| 396 | E1F670_GIAIA | Giardia intestinalis |
| 397 | E1F685_GIAIA | Giardia intestinalis |
| 398 | E1F6C5_GIAIA | Giardia intestinalis |
| 399 | E1F6G2_GIAIA | Giardia intestinalis |
| 400 | E1F6H9_GIAIA | Giardia intestinalis |
| 401 | E1F6I0_GIAIA | Giardia intestinalis |
| 402 | E1F6L8_GIAIA | Giardia intestinalis |
| 403 | E1F6M3_GIAIA | Giardia intestinalis |
| 404 | E1F6Q9_GIAIA | Giardia intestinalis |
| 405 | E1F6T5_GIAIA | Giardia intestinalis |
| 406 | E1F6V8_GIAIA | Giardia intestinalis |
| 407 | E1F727_GIAIA | Giardia intestinalis |
| 408 | E1F734_GIAIA | Giardia intestinalis |
| 409 | E1F771_GIAIA | Giardia intestinalis |
| 410 | E1F772_GIAIA | Giardia intestinalis |
| 411 | E1F797_GIAIA | Giardia intestinalis |
| 412 | E1F7B5_GIAIA | Giardia intestinalis |
| 413 | E1F7B6_GIAIA | Giardia intestinalis |
| 414 | E1F7D7_GIAIA | Giardia intestinalis |
| 415 | E1F7F9_GIAIA | Giardia intestinalis |
| 416 | E1F7P6_GIAIA | Giardia intestinalis |
| 417 | E1F7U6_GIAIA | Giardia intestinalis |
| 418 | E1F7W8_GIAIA | Giardia intestinalis |
| 419 | E1F7X0_GIAIA | Giardia intestinalis |
| 420 | E1F7X8_GIAIA | Giardia intestinalis |
| 421 | E1F7Z9_GIAIA | Giardia intestinalis |
| 422 | E1F856_GIAIA | Giardia intestinalis |
| 423 | E1F891_GIAIA | Giardia intestinalis |
| 424 | E1F8E1_GIAIA | Giardia intestinalis |
| 425 | E1F8F3_GIAIA | Giardia intestinalis |
| 426 | E1F8K1_GIAIA | Giardia intestinalis |
| 427 | E1F8M3_GIAIA | Giardia intestinalis |
| 428 | E1F8N7_GIAIA | Giardia intestinalis |
| 429 | E1F8N8_GIAIA | Giardia intestinalis |
| 430 | E1F8P0_GIAIA | Giardia intestinalis |
| 431 | E1F8P4_GIAIA | Giardia intestinalis |
| 432 | E1F8Q3_GIAIA | Giardia intestinalis |
| 433 | E1F8Q5_GIAIA | Giardia intestinalis |
| 434 | E1F8Q9_GIAIA | Giardia intestinalis |
| 435 | E1F8S0_GIAIA | Giardia intestinalis |
| 436 | E1F8S1_GIAIA | Giardia intestinalis |
| 437 | E1F8U6_GIAIA | Giardia intestinalis |
| 438 | E1F8U7_GIAIA | Giardia intestinalis |
| 439 | E1F8V9_GIAIA | Giardia intestinalis |
| 440 | E1F8W0_GIAIA | Giardia intestinalis |
| 441 | E1F8W3_GIAIA | Giardia intestinalis |
| 442 | E1F8Y1_GIAIA | Giardia intestinalis |
| 443 | E1F8Z1_GIAIA | Giardia intestinalis |
| 444 | E1F917_GIAIA | Giardia intestinalis |
| 445 | E1F930_GIAIA | Giardia intestinalis |
| 446 | E1F954_GIAIA | Giardia intestinalis |
| 447 | E1F987_GIAIA | Giardia intestinalis |
| 448 | E1F9D3_GIAIA | Giardia intestinalis |
| 449 | E1F9D5_GIAIA | Giardia intestinalis |
| 450 | E1F9E4_GIAIA | Giardia intestinalis |
| 451 | E1F9F7_GIAIA | Giardia intestinalis |
| 452 | E1F9H3_GIAIA | Giardia intestinalis |
| 453 | E1F9I2_GIAIA | Giardia intestinalis |
| 454 | E1F9I5_GIAIA | Giardia intestinalis |
| 455 | E1F9J0_GIAIA | Giardia intestinalis |
| 456 | E1F9J2_GIAIA | Giardia intestinalis |
| 457 | E1F9L1_GIAIA | Giardia intestinalis |
| 458 | E1F9M5_GIAIA | Giardia intestinalis |
| 459 | E1F9M9_GIAIA | Giardia intestinalis |
| 460 | E1F9N1_GIAIA | Giardia intestinalis |
| 461 | E1F9N2_GIAIA | Giardia intestinalis |
| 462 | E1F9Q7_GIAIA | Giardia intestinalis |
| 463 | E1F9R4_GIAIA | Giardia intestinalis |
| 464 | E1F9R6_GIAIA | Giardia intestinalis |
| 465 | E1F9U1_GIAIA | Giardia intestinalis |
| 466 | E2RTM9_GIAIN | Giardia intestinalis |
| 467 | E2RTN8_GIAIC | Giardia intestinalis |
| 468 | E2RTU6_GIAIC | Giardia intestinalis |
| 469 | E2RTV3_GIAIC | Giardia intestinalis |
| 470 | E2RTX4_GIAIC | Giardia intestinalis |
| 471 | E2RU01_GIAIC | Giardia intestinalis |
| 472 | E2RU12_GIAIC | Giardia intestinalis |
| 473 | E2RU28_GIAIC | Giardia intestinalis |
| 474 | E2RU34_GIAIC | Giardia intestinalis |
| 475 | E2RU43_GIAIC | Giardia intestinalis |
| 476 | E2RU54_GIAIC | Giardia intestinalis |
| 477 | E5EZ44_GIAIN | Giardia intestinalis |
| 478 | E5EZ45_GIAIN | Giardia intestinalis |
| 479 | E5EZ46_GIAIN | Giardia intestinalis |
| 480 | E5EZ47_GIAIN | Giardia intestinalis |
| 481 | G0QQQ1_ICHMG | Ichthyophthirius multifiliis |
| 482 | G0QTU6_ICHMG | Ichthyophthirius multifiliis |
| 483 | O97443_GIAIN | Giardia intestinalis |
| 484 | O97444_GIAIN | Giardia intestinalis |
| 485 | O97448_GIAIN | Giardia intestinalis |
| 486 | O97450_GIAIN | Giardia intestinalis |
| 487 | TSA4_GIAIN | Giardia intestinalis |
| 488 | VS41_GIAIN | Giardia intestinalis |
| 489 | TS11_GIAIN | Giardia intestinalis |
| 490 | Q07317_GIAIN | Giardia intestinalis |
| 491 | Q0R0E0_GIAIN | Giardia intestinalis |
| 492 | Q22M55_TETTS | Tetrahymena thermophila |
| 493 | Q234X6_TETTS | Tetrahymena thermophila |
| 494 | Q24959_GIAIN | Giardia intestinalis |
| 495 | Q24960_GIAIN | Giardia intestinalis |
| 496 | Q24962_GIAIN | Giardia intestinalis |
| 497 | Q24970_GIAIN | Giardia intestinalis |
| 498 | Q24971_GIAIN | Giardia intestinalis |
| 499 | Q24977_GIAIN | Giardia intestinalis |
| 500 | Q24986_GIAIN | Giardia intestinalis |
| 501 | Q24987_GIAIN | Giardia intestinalis |
| 502 | Q24988_GIAIN | Giardia intestinalis |
| 503 | Q24990_GIAIN | Giardia intestinalis |
| 504 | Q24992_GIAIN | Giardia intestinalis |
| 505 | Q38QK0_GIAIN | Giardia intestinalis |
| 506 | Q49L26_GIAMU | Giardia muris |
| 507 | Q49L27_GIAMU | Giardia muris |
| 508 | Q49L28_GIAMU | Giardia muris |
| 509 | Q49L29_GIAMU | Giardia muris |
| 510 | Q49L30_GIAMU | Giardia muris |
| 511 | Q49L31_GIAMU | Giardia muris |
| 512 | Q4RPQ0_TETNG | Tetraodon nigroviridis |
| 513 | Q7JNB5_GIAIN | Giardia intestinalis |
| 514 | Q7M3R4_GIAIN | Giardia intestinalis |
| 515 | Q8I0M3_GIAIN | Giardia intestinalis |
| 516 | Q8I0P4_GIAIN | Giardia intestinalis |
| 517 | Q8I8V1_GIAIN | Giardia intestinalis |
| 518 | Q8I8V2_GIAIN | Giardia intestinalis |
| 519 | Q8I8V3_GIAIN | Giardia intestinalis |
| 520 | Q8I8V4_GIAIN | Giardia intestinalis |
| 521 | Q8I8V5_GIAIN | Giardia intestinalis |
| 522 | Q8I8V6_GIAIN | Giardia intestinalis |
| 523 | Q8I8V7_GIAIN | Giardia intestinalis |
| 524 | Q8I8V8_GIAIN | Giardia intestinalis |
| 525 | Q8I8V9_GIAIN | Giardia intestinalis |
| 526 | Q8I8W0_GIAIN | Giardia intestinalis |
| 527 | Q8I8W1_GIAIN | Giardia intestinalis |
| 528 | Q8I8W2_GIAIN | Giardia intestinalis |
| 529 | Q8I8W3_GIAIN | Giardia intestinalis |

TABLE 1-continued

Exemplary list of VSP and VSP-like proteins that can be used as VSP carriers.

| SEQ ID NO | UNIPROT IDENTIFIER | SPECIES |
|---|---|---|
| 530 | Q8I8W4_GIAIN | *Giardia intestinalis* |
| 531 | Q8I8W6_GIAIN | *Giardia intestinalis* |
| 532 | Q8MPM6_GIAIN | *Giardia intestinalis* |
| 533 | Q95PT9_GIAIN | *Giardia intestinalis* |
| 534 | Q95WU1_GIAIN | *Giardia intestinalis* |
| 535 | Q967R8_GIAIN | *Giardia intestinalis* |
| 536 | Q967R9_GIAIN | *Giardia intestinalis* |
| 537 | Q9BH65_GIAIN | *Giardia intestinalis* |
| 538 | Q9BIJ8_GIAIN | *Giardia intestinalis* |
| 539 | Q9BIJ9_GIAIN | *Giardia intestinalis* |
| 540 | Q9BIK0_GIAIN | *Giardia intestinalis* |
| 541 | Q9BIK1_GIAIN | *Giardia intestinalis* |
| 542 | Q9BIK2_GIAIN | *Giardia intestinalis* |
| 543 | Q9BIK3_GIAIN | *Giardia intestinalis* |
| 544 | Q9BIK4_GIAIN | *Giardia intestinalis* |
| 545 | Q9BIK5_GIAIN | *Giardia intestinalis* |
| 546 | Q9BIK6_GIAIN | *Giardia intestinalis* |
| 547 | Q9BIK7_GIAIN | *Giardia intestinalis* |
| 548 | Q9BIK8_GIAIN | *Giardia intestinalis* |
| 549 | Q9BIK9_GIAIN | *Giardia intestinalis* |
| 550 | Q9BIL0_GIAIN | *Giardia intestinalis* |
| 551 | Q9BIL1_GIAIN | *Giardia intestinalis* |
| 552 | Q9BIL2_GIAIN | *Giardia intestinalis* |
| 553 | Q9BIL3_GIAIN | *Giardia intestinalis* |
| 554 | Q9BIL4_GIAIN | *Giardia intestinalis* |
| 555 | Q9BIL5_GIAIN | *Giardia intestinalis* |
| 556 | Q9BIL6_GIAIN | *Giardia intestinalis* |
| 557 | Q9BIL7_GIAIN | *Giardia intestinalis* |
| 558 | Q9BIL8_GIAIN | *Giardia intestinalis* |
| 559 | Q9BIL9_GIAIN | *Giardia intestinalis* |
| 560 | Q9BIM0_GIAIN | *Giardia intestinalis* |
| 561 | Q9BIM1_GIAIN | *Giardia intestinalis* |
| 562 | Q9BIM2_GIAIN | *Giardia intestinalis* |
| 563 | Q9BIM3_GIAIN | *Giardia intestinalis* |
| 564 | Q9GQ40_GIAIN | *Giardia intestinalis* |
| 565 | Q9GQ41_GIAIN | *Giardia intestinalis* |
| 566 | Q9GQ42_GIAIN | *Giardia intestinalis* |
| 567 | Q9GQ43_GIAIN | *Giardia intestinalis* |
| 568 | Q9GQ44_GIAIN | *Giardia intestinalis* |
| 569 | Q9GQ45_GIAIN | *Giardia intestinalis* |
| 570 | Q9GQ46_GIAIN | *Giardia intestinalis* |
| 571 | Q9GQ47_GIAIN | *Giardia intestinalis* |
| 572 | Q9GS24_GIAIN | *Giardia intestinalis* |
| 573 | Q9GSP6_GIAIN | *Giardia intestinalis* |
| 574 | Q9NGL3_GIAIN | *Giardia intestinalis* |
| 575 | Q9NGZ3_GIAIN | *Giardia intestinalis* |
| 576 | Q9NGZ6_GIAIN | *Giardia intestinalis* |
| 577 | Q9NGZ7_GIAIN | *Giardia intestinalis* |
| 578 | Q9NH87_GIAIN | *Giardia intestinalis* |
| 579 | Q9U013_GIAIN | *Giardia intestinalis* |
| 580 | Q9U018_GIAIN | *Giardia intestinalis* |
| 581 | Q9U019_GIAIN | *Giardia intestinalis* |
| 582 | Q9U021_GIAIN | *Giardia intestinalis* |
| 583 | Q9U048_GIAIN | *Giardia intestinalis* |
| 584 | Q9U063_GIAIN | *Giardia intestinalis* |
| 585 | Q9U064_GIAIN | *Giardia intestinalis* |
| 586 | Q9XTJ7_GIAIN | *Giardia intestinalis* |
| 587 | Q9XTK3_GIAIN | *Giardia intestinalis* |
| 588 | Q9XY90_GIAIN | *Giardia intestinalis* |

TABLE 1 includes the sequences of 585 VSP and VSP-like proteins comprising Interpro *Giardia* variant-specific surface protein motif IPR005127 (sequence list published online at embl-ebi.org/interpro/IEntry?ac=IPR005127 and publicly available on Jun. 12, 2012). Other VSP and VSP-like proteins that can be used as VSP carriers according to the present disclosure are the 1,079 protein sequences comprising the *Giardia* variant-specific surface protein motif PF03302 available at Version 26.0 of the Pfam database (sequence list published online at pfam.sanger.ac.uk/family/PF03302 and publicly available on Jun. 12, 2012). The lists of protein sequences published in the above cited databases and publicly available on the above disclosed dates are herein incorporated by reference in their entireties.

As above-mentioned, the *Giardia* VSPs and more particularly the extracellular domain of the *Giardia* VSPs comprise multiple CXXC (SEQ ID NO:589) motifs, preferably multiple CXXC (SEQ ID NO:589) motifs separated by several amino acids, from 3 to 20 amino acids and more particularly from 5 to 8 amino acids (as observed by multiple sequence alignments). Thus, in some embodiments, the VSP carrier is a fragment, analog or derivative of a VSP or VSP-like protein from *Giardia*, wherein the VSP carrier comprises 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39 or 40 CXXC (SEQ ID NO:589) motifs. In some embodiments, the VSP carrier comprises at least about 40, at least about 50, at least about 60, at least about 70, at least 80, about 90 or at least about 100 CXXC (SEQ ID NO:589) motifs from a *Giardia* VSP.

In a particular embodiment, the *Giardia* parasite is *Giardia lamblia*. In one embodiment, the *Giardia* VSP can be without limitation VSP9B10 (Uniprot:Q9GS24), VSP1267 (Uniprot:Q07317), VSPA6 (Uniprot:Q24970), VSPS1 (Uniprot:Q8I0P4), VSPS2 (Uniprot:Q8I8W6), VSPS3 (Uniprot: Q8I0M3), VSPS4 (Uniprot: E2RTM9), VSPS5 (Uniprot: Q8I8W4), VSPS6 (Uniprot:Q8I8W3), VSPS7 (Uniprot: Q8I8W2), VSPS8 (Uniprot:E2RTU6), VSPAS1 (Uniprot: Q8I0M3), VSPAS2 (Uniprot:818W0), VSPAS3 (Uniprot: Q8I8V9), VSPAS4 (Uniprot:Q8I0P4), VSPAS5 (Uniprot: Q8I8V8), VSPAS6 (Uniprot:Q8I8V7), VSPAS7 (Uniprot: Q8I8V6), VSPAS8 (Uniprot:Q8I8V5), VSPAS9 (Uniprot: Q8I8V4), VSPAS10 (Uniprot:Q8I8V3), VSPAS11 (Uniprot: Q8I8V2), VSPAS12 (Uniprot:E2RU01) or VSPH7 (Uniprot: □24992) of *Giardia lamblia*, or fragments, variants, or derivatives thereof.

In one embodiment, a VSP carrier comprises the extracellular domain of a *Giardia* VSP, or a fragment, variant or derivative thereof (since said extracellular domain is the amino-terminal cysteine rich region comprising multiple CXXC (SEQ ID NO:589) motifs of the *Giardia* VSP protein).

The extracellular domain of a *Giardia* VSP is the domain resistant to the pH, temperature and proteolytic digestion. Accordingly, in another embodiment, the VSP carrier according to the invention comprises only the extracellular domain of a *Giardia* VSP, or a fragment, variant, or derivative thereof. In a particular embodiment, the VSP carrier comprises the extracellular sequence of VSP1267 (SEQ ID NO:2), comprising the N-terminal signal peptide. The transmembrane region and the cytoplasmic tail of a *Giardia* VSP are thus eliminated. It should be noted that the peptide signal can also be removed from the VSP extracellular domain.

A list of VSP and VSP-like proteins suitable to generate VSP carriers, including their sequences, Uniprot Accession Numbers, and Uniprot Entry Names is included at the end of this specification. The correspondence between Uniprot Accession Nos. and Entry Names and VSP protein number can be determined from the Uniprot entry at www.uniprot.org. E.g., Uniprot Accession No, Q07317 and its Entry Name Q07317_GIAIN would correspond to VSP1267.

The term "VSP1267 carrier" refers to a recombinantly produced fragment of the *Giardia* VSP protein VSP1267 without the transmembrane domain and cytosolic tail, but with the signal peptide intact and further comprising a C-terminal His6 tag (SEQ ID NO:1, shown in FIG. 5A). In some embodiments, a VSP carrier is a fragment, variant, or derivative of the extracellular domain of VSP1267 (protein sequence is SEQ ID NO:2; DNA coding sequence is SEQ ID NO: 4). In other embodiments, a VSP carrier is a fragment, variant, or VSP9B10 (protein sequence is SEQ ID NO:3; DNA coding sequence is SEQ ID NO: 5). See TABLE 2.

TABLE 2

Protein and DNA Sequences of exemplary VSP carriers.

| Variant-specific surface protein (VSP) 1267 (without transmembrane domain and cytosolic tail) | *Giardia lamblia* EMBL AAA29159.1 |
|---|---|

Protein Sequence (signal peptide is underlined) (SEQ ID NO: 2)

<u>MLLIAFYLILSTFA</u>VDCKNSGNSCEAGQCDTIGDTEICMQCNQGKVPINGICTAHSEEAVTNAGCKKNG

GTNIEESDKVCGQCGNGYFLHKGGCYKIGEAPGNLICADEASNEGARTAGVCGACKDGYYKNSDAVATA

DSCIACEDANCATCGGAGENKCTKCIDGYFVGATGNEGGCIKCDATTGPNSYKGVAGCAKCEKPKNAGP

AKCIECAADYLKTEADEQTSCVSEAVCREGKTHFPTTDSAGGNKKVCVSCGTTNNGGIENCGECTSKES

AARAGTEITCTKCSSNNLSPLGDACLTDCPAGTYAVSGDSGSVCKPCHNTCAGCQTDDRETSCTACSPG

YSLLYESEGATGRCVKECTGAFITNCADGQCTANVGGAKYCTQCKDGYAPIDGICTAVAAAGRDVSVCT

ATGGKCTACTGNYALLSGGCYNTQTLPGKSVCKAVANSNDGKCKTCANGQAPDPATNFCPLCDSTCAEC

STKNDADACTKCFPGYYKTGNKCIKCTESSENGKKIDGIPDCLSCEAPINTGPAICYVKTDGTSDDNSG

NGGDSTNKSGLST

DNA Sequence (sequence encoding the signal peptide is underlined) (SEQ ID NO: 4)

<u>ATGTTGTTGATAGCCTTCTATCTTATATTATCTACATTTGCA</u>GTAGATTGCAAGAATAGTGGAAATAGT

TGTGAAGCTGGCCAATGTGATACGATTGGCGATACTGAAATCTGTATGCAATGTAATCAAGGGAAAGTA

CCCATCAATGGAATATGTACAGCCCATAGTGAAGAAGCAGTCACTAACGCTGGTTGTAAGAAGAACGGG

GGTACTAATATAGAAGAAAGTGATAAGGTATGTGGACAATGTGGAAATGGCTACTTCCTGCACAAAGGC

GGATGCTATAAGATAGGAGAGGCTCCTGGCAATCTCATCTGTGCGGATGAGGCGTCAAATCCTGGTGCA

CGTACTGCAGGGGTGTGTGGTGCTTGCAAGGATGGCTATTATAAGAATTCGGATGCTGTTGCAACTGCA

GACTCCTGTATAGCATGTGAAGATGCCAACTGTGCCACATGTGGAGGAGCTGGTGAAAACAAATGTACA

AAATGTATAGACGGATACTTTGTTGGAGCAACTGGAAATGAAGGTGGGTGCATAAAATGTGACGCTACC

ACAGGGCCTAATAGCTACAAAGGAGTTGCTGGATGTGCTAAATGTGAAAAGCCAAAGAACGCTGGTCCT

GCAAAGTGCATTGAATGTGCTGCTGATTATTTGAAAACAGAAGCAGATGAACAAACGTCTTGCGTTAGC

GAAGCCGTGTGCAGAGAAGGCAAGACGCACTTCCCCACTACTGACAGCGCTGGTGGTAACAAGAAGGTA

TGCGTAAGTTGTGGCACAACGAATAATGGCGGCATAGAAAACTGTGGAGAATGCACCTCTAAGGAAAGC

GCTGCACGGGCAGGACAGAGATCACCTGCACCAAATGCTCTAGCAATAATCTGAGCCCCCTGGGAGAC

GCGTGTCTAACAGACTGCCCTGCCGGAACGTATGCCGTTAGTGGCGACAGCGGCAGTGTCTGCAAGCCC

TGTCACAACACGTGCGCCCGCTGCCAGACCGACGACAGGGAGACTTCCTGCACGGCCTGCTcCCCTGGA

TACTCCCTTCTGTATGAGTCCAACGGAGCAACTGGGAGGTGCGTCAAGGAGTGCACTGGTGCGTTCATT

ACCAACTGTGCGGACGGGCAGTGCACGGCTAACGTCGGGGGTGCGAAGTACTGCACCCAGTGCAAGGAC

GGGTACGCCCCGATCGACGGGATCTGTACAGCGGTGGCAGCTGCCGGGAGAGACGTGAGCGTGTGCACG

GCCACAGGTGGCAAGTGCACGGCATGTACAGGCAACTATGCGTTATTATCAGGTGGATGTTATAACACA

CAAACACTTCCTGGAAAGTCAGTATGTAAAGCCGTGGCTAATAGCAATGACGGGAATGCAAAACATGT

GCCAATGGTCAAGCACCAGATCCTGCTACTAATTTCTGCCCATTGTGTGATTCAACTTGTGCAGAATGT

TCAACTAAAAATGATGCTGATGCTTGTACAAAATGTTTTCCAGGATACTATAAAACAGGAAATAAGTGT

ATCAAATGTACAGAAAGTAGTAATAACGAAAAAAGATCGATGGAATACCTGATTGTTTAAGTTGTGAA

GCACCGATTAATACTGGTCCTGcCATCTGCTACGTTAAAACGGATGGCACTAGCGATGATAACAGCGGC

AATGGTGGAGACAGCACCAACAAGAGCGGCCTTTCCACTGGC

TABLE 2-continued

Protein and DNA Sequences of exemplary VSP carriers.

| | |
|---|---|
| Variant-specific surface protein (VSP) WB/9B10-B | *Giardia lamblia*) EMBL AAK97086.1 |

Protein Sequence (SEQ ID NO: 3)

MFMSFVLAGVLVQIAWAGKATERAAQCADNTNCAEEACNVLIGGKLYCSRCNTGFVPINGQCADKEGAT

DQCKDGSGGDTADQTCGQCAEQTFMYKGGCYEAAQQPGQTMCQAADAGVCTQAAQGYFIPPGADASHQS

VIPCGDEEGITVKNDKKYKGVLHCTRCYAPTEAADANAKAATCTACGDSKIVKTAKDSATSCVTEEECT

GTKTCKTCAEGTSDGCATCEKGADGAVACKTCGSNKKVQPNKKGCIAKCPETVSAEKDGVCECVEGYVP

DNAGTGCTKKPDPQCNTPGCKTCSEPKTSKEVCTECEDPKALTPTGQCIYGCEHLEGYYEGTSEGGKKA

CKKCEVENCLLCNGQGQCETCKDGYYKSGAACAKCNTSCKTCANGNSNGCTSCEPKQVLSYEGEGTGTC

KPGCKPVSGGKDGTCKSCDLNIDGTSYCSACNVGTEYPENGVCVKKSARTASCQAEPSNGVCGTCARGF

FRMNGGCYETTKLPGKSVCEEVASAGDTCQTPADGYKLNNGALITCSAGCKTCTSQDQCDTCKAGYAKT

GGNTKKCVPCATGCSECNADDATKCTVCAAGYYLSKEKCIACDKSDGGSITGVANCANCAPPTNNKGPV

LCYLIQNTNRSGLSTG

DNA Sequence (SEQ ID NO: 5)

ATGTTTGGCAGTTTTGTTCTCGCGGGGTACTCGTCCAGATTGCATGGGCAGGAAAAGCAACAGAGCGC

GCGGCTCAATGCGCAGATAACACTAATTGCGCAGAGGAAGCATGCAACGTTCTGATCGGTGGTAAATTG

TATTGCTCTCGATGTAACACAGGATTTGTTCCTATCAATGGACAATGTGCAGACAAAGAAGGTGCAACA

GATCAGTGCAAAGATGGCTCCGGAGGCGATACAGCTGATCAGACCTGTGGACAGTGCGCCGAGCAGACT

TTCATGTACAAGGGCGGCTGTTACGAAGCAGCCCAGCAGCCCGGACAGACCATGTGTCAGGCGGCAGAT

GCTGGAGTATGCACACAAGCCGCGCAAGGATACTTCGTGCCGCCGGGCGCAGACGCCTCTCACCAATCG

GTCATACCATGCGGAGACGAAGAGGGAATAACAGTTAAGAACGATAAAAAGTACAAGGGCGTGCTGCAC

TGCACTCGGTGTTACGCTCCCACAGAAGCAGCAGATGCTAACGCCAAGGCCGCCACGTGTACTGCGTGC

GGCGATAGCAAGATCGTCAAGACAGCCAAGGACTCAGCCACCTCCTGCGTGACAGAAGAAGAGTGCACC

GGCACCAAGACGTGCAAGACGTGCGCCGAGGGGACCTCCGACGGGTGTGCGACGTGCGAGAAGGGCGCC

GATGGAGCAGTCGCCTGCAAGACGTGCGGGTCTAATAAGAAGGTCCAGCCAAACAAGAAGGGGTGCATA

GCAAAGTGCCCGGAGACGGTGAGTGCCGAGAAGGATGGCGTTTGTGAGTGCGTCGAGGGCTACGTTCCC

GACAACGCGGGCACCGGGTGCACGAAGAAGCCCGACCCCCAGTGCAACACCCCCGGCTGCAAGACGTGC

AGTGAGCCGAAGACAAGCAAGGAGGTGTGCACAGAGTGCGAAGACCCCAAGGCCCTCACGCCCACGGGC

CAGTGCATCTACGGTTGTGAGCACCTGGAAGGCTACTACGAGGGCACCAGCGAGGGGGGCAAGAAGGCC

TGCAAGAAGTGCGAGGTCGAGAACTGCCTCCTGTGCAACGGGCAAGGACAGTGCGAGACCTGCAAGGAC

GGGTACTACAAGAGCGGAGCCGCCTGTGCCAAGTGCAATACCTCGTGCAAGACGTGCGCGAACGGGAAC

TCCAACGGGTGCACGAGCTGCGAGCCTAAGCAGGTCCTCAGCTACGAAGGAGAGGGCACGGGGACGTGC

AAGCCAGGCTGCAAGCCAGTGAGCGGCGGCAAGGATGGAACGTGCAAGAGCTGCGACCTGAACATAGAC

GGGACAAGCTACTGTTCTGCCTGTAACGTGGGCACGGAGTATCCAGAGAACGGCGTGTGCGTCAAGAAG

TCGGCCCGCACAGCCTCCTGCCAGGCAGAACCGAGCAATGGTGTGTGCGGGACATGTGCAAGGGGCTTC

TTCCGCATGAACGGGGCTGCTACGAAACGACCAAACTCCCTGGAAAGAGCGTCTGTGAGGAGGTAGCA

TCGGCCGGCGATACCTGTCAGACTCCGGCCGACGGATACAAGCTGAATAATGGCGCGCTCATCACTTGC

TCGGCCGGATGTAAGACGTGCACCAGCCAGGACCAGTGCGACACGTGTAAGGCTGGATATGCTAAGACT

GGCGGTAACACTAAGAAGTGCGTTCCCTGCGCCACTGGGTGCTCCGAGTGCAATGCGGACGACGCCACC

AAGTGCACGGTGTGCGCTGCAGGGTACTACCTGTCCAAAGAAAAGTGCATAGCATGCGACAAGAGCGAC

TABLE 2-continued

Protein and DNA Sequences of exemplary VSP carriers.

GGCGGATCCATCACCGGCGTCGCCAACTGCGCCAACTGCGCTCCCCCAACCAACAATAAAGGGCCTGTC

CTCTGCTACCTCATACAGAACACCAACAGGAGCGGGCTTTCCACG

VSP Carriers from VSP-like Domains

In some embodiments, a VSP carrier comprises a VSP sequence chosen from among VSP-like domains, fragments, variants or derivatives thereof from microorganisms other that *Giardia*. These VSP-like proteins share sequence homology and biochemical properties with *Giardia* VSPs. In some embodiments, VSP-like sequences selected to be used as VSP carriers comprise multiple CXXC (SEQ ID NO:589) motifs. In some embodiments, such multiple CXXC (SEQ ID NO:589) motifs are separated by 5 to 8 amino acids.

Alignment of the sequence of the extracellular domain of the *Giardia* VSP1267, used herein as an exemplary VSP carrier, with other VSP-like molecules sequences has led to observe the presence of multiple CXXC (SEQ ID NO:589) motifs, notably separated by 5 to 8 amino acids, in proteins belonging to *Paramecium, Tetrahymena* and *Entamoeba* species. Thus, representative fragments of primary sequences of surface kinases of *Entamoeba* sp., and surface proteins of *Paramecium* sp. and *Tetrahymena* sp. predict a conserved domain containing CXXC (SEQ ID NO:589) motifs in a VSP-like architecture (compared with *Giardia* VSP 1267, 9B10 (SEQ ID NO:3), and H7 as responsible for resistance to pH, temperature and proteolytic digestion).

In one embodiment, the *Tetrahymena* microorganism is *Tetrahymena thermophila*. In another embodiment, the *Entamoeba* microorganism is *Entamoeba histolytica*. In another embodiment, the *Paramecium* microorganism is *Paramecium tetraurelia*.

In one embodiment, the VSP carrier comprises the extracellular domain of a VSP-like protein, or a fragment, variant or derivative thereof (since said extracellular domain is the amino-terminal cysteine rich region comprising multiple CXXC (SEQ ID NO:589) motifs of the *Giardia* VSP protein). In another embodiment, the VSP carrier comprises only the extracellular domain of a VSP-like protein, or fragment, variant, or derivative thereof.

Thus, in some embodiments, the VSP carrier is a fragment, analog or derivative of a VSP-like protein comprising 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39 or 40 CXXC (SEQ ID NO:589) mmotifs. In some embodiments, the VSP carrier comprises at least about 40, at least about 50, at least about 60, at least about 70, at least 80, about 90 or at least about 100 CXXC (SEQ ID NO:589) motifs from a VSP-like protein.

VSPs as Therapeutic Agent Carriers

The VSP carriers can be used to deliver therapeutic agents to a subject in need thereof. Thus, in some embodiments, the present disclosure provides a therapeutic composition comprising a VSP carrier and a therapeutic agent. This therapeutic composition can be formulated, for example, for oral administration. In some embodiments, the therapeutic composition is formulated for mucosal administration. As disclosed above, the VSP carrier can comprise without limitation a VSP, a VSP-like protein, a VSP or VSP-like protein fragment, a VSP or VSP-like protein derivative, or a combination of two or more of said VSP carriers. In specific embodiments, the VSP carrier comprises a VSP from *Giardia* (e.g., VSP1267) or a fragment thereof, e.g., a VSP extracellular domain or a fragment of such extracellular domain.

In some embodiments, the VSP carrier comprises a VSP protein sequence and further comprises a heterologous moiety, for example, a purification tag such as a Hi6 tag. In other embodiments, the heterologous moiety can be a protein, peptide, polymer, etc. that can improve a pharmokinetic or pharmacodynamic property such as half-life. In a specific embodiment, the VSP carrier is SEQ ID NO:1, i.e., the extracellular domain of *Giardia* VSP1267, including the N-terminal signal peptide, and a C-terminal His6 tag.

Therapeutic agents that can be delivered by a VSP carrier include biological agents. The term "biological agent" includes both proteins and non-protein therapeutic agents. Exemplary non-protein therapeutic agents include polysaccharides, lipids, drugs (e.g., small molecule drugs), nucleic acids (e.g., oligonucleotides), lipopolysaccharides, ribozymes, genetic materials, prions, viruses, etc.

In some embodiments of the present invention, the therapeutic agent is a pharmacologically active polypeptide. In some embodiments, the polypeptide is a bioactive peptide, e.g., a cytokine, an interleukin (e.g., IL-2 or IL-10), a hormone (e.g., parathormone), a growth factor, or a receptor. In specific embodiments, the bioactive peptides can be, without limitation, insulin, human growth hormone, glucagon, parathormone, IL-2, IL-10, as well as fragments, analogs, derivatives or variants thereof, or combinations of two or more of these bioactive peptides. The examples provided above are non-limiting, and it is contemplated that a VSP carrier can be used to delivered other bioactive peptides and proteins. For example, VSP carriers can be used for oral or mucosal delivery of proteins comprising antigen-binding domains such antibodies and fragments thereof (e.g., scFv's or scFv-comprising molecules).

In some specific embodiments, the bioactive peptide is insulin, e.g., a natural insulin, a recombinant insulin, or an insulin analog. In some embodiments, the insulin analog is a fast-acting insulin (e.g., insulin aspart), a long-lasting insulin (e.g., insulin glargine) or a combination thereof. Numerous insulin analogs are known in the art.

Therapeutics agents can also include classical low molecular weight therapeutic agents commonly referred to as drugs, including but not limited to antineoplastic, immunosupressants, antioproliferatives, antithrombins, antiplatelet, antilipid, anti-inflammatory, angiogenic, antiangiogenic, vitamins, ACE inhibitors, vasoactive substances, antimitotics, metalloproteinase inhibitors, NO donors, estradiols, or antisclerosing agents, alone or in combination. In some embodiments, the drug is a drug poorly soluble under aqueous conditions, for example an antibiotic.

The therapeutic agent can also be a compound that needs to be activated in order to be therapeutically active, e.g., a prodrug or a zymogen. In such embodiments, the therapeutic agent is metabolized into the desired drug or biological agent after it has been administered to a subject in combination with a VSP carrier.

In some embodiments, the VSP carrier is bound directly to the therapeutic agent. In other aspects, the VSP carrier is bound to a vector particle containing the therapeutic agent. Accordingly, the vector particle can be a viral particle, a virus-like particle (VLP), a nanoparticle, or a liposome. In one particular aspect, the vector particle is a viral particle displaying at its surface the therapeutic agent. In another aspect, the vector particle is a viral which does not display the therapeutic agent on its surface. In one particular aspect, the vector particle is a VLP displaying at its surface the therapeutic agent. In another aspect, the vector particle is a VLP encapsulating the therapeutic agent. In one particular aspect, the vector particle is a nanoparticle displaying at its surface the therapeutic agent. In another aspect, the vector particle is a nanoparticle encapsulating the therapeutic agent. In one particular aspect, the vector particle is a liposome displaying at its surface the therapeutic agent. In another aspect, the vector particle is a liposome encapsulating the therapeutic agent. In another particular aspect, the therapeutic agent is contained within the surface of the vector particle, e.g., within a lipid bilayer in a liposome.

In a particular embodiment, the vector particle is a virus-like particle (VLP). Where virus-like particles are being used, they can be prepared according to techniques known in the art and for example as described in Intl. Pat. Appl. Publ. No. WO 2002/34893, which is incorporated therein by reference in its entirety. In some embodiments, the VLP displays at its surface a VSP carrier and a therapeutic agent. Thus, in some embodiments, a VSP carrier can be bound to a therapeutic agent exposed at the surface of the VLP.

The VSP carrier according to the invention can form a protecting surface (as it occurs naturally in the parasite trophozoites) that allows for the correct delivery of the therapeutic agent into the mucosa (e.g., intestinal mucosa), without suffering degradation in the digestive tract.

In certain embodiments, the VSL carriers provided herein are not covalently attached to the therapeutic agents via peptidic bonds. Thus, prior to administration, a VSP carrier is "combined" with at least one therapeutic agent. As disclosed above, the term "combine" refers to the process of admixing two or more components (e.g., a VSP carrier and a therapeutic agent) such that contact between the components occur and such contact allows the binding of the two or more components.

In some embodiments, a VSP carrier can be combined with one therapeutic agent. In other embodiments, a VSP carrier can be combined with more than one therapeutic agent. In some embodiments when a VSP carrier is combined with more than one therapeutic agent, the VSP carrier can bind to only one of the therapeutic agents. In other embodiments, the VSP carrier can bind to more than one of the therapeutic agents.

In some embodiments, two or more VSP carriers can be combined with one therapeutic agent. In other embodiments, two or more than two VSP carriers can be combined with more than one therapeutic agent. In some embodiments, when two or more than two VSP carriers are combined with more than one therapeutic agent, each VSP carrier can bind to only one of the therapeutic agents. In other embodiments, each VSP carrier can bind to more than one therapeutic agent.

In some embodiments, the molecule to molecule ratio of VSP carrier to therapeutic agent (VSP carrier:therapeutic agent) ranges from about 10:1 to about 1:10. In other embodiments, the molecule to molecule ratio of VSP carrier to therapeutic agent (VSP carrier:therapeutic agent) ranges from about 3:1 to about 1:3. In some embodiments, the molecule to molecule ratio of VSP carrier to therapeutic agent (VSP carrier:therapeutic agent) is 3:1. In other embodiments, the molecule to molecule ratio of VSP carrier to therapeutic agent (VSP carrier:therapeutic agent) is 1:1.

In some embodiments, the molecule to molecule ratio of VSP carrier to therapeutic agent (VSP carrier:therapeutic agent) is about 1:1, about 2:1, about 3:1, about 4:1, about 5:1, about 6:1, about 7:1, about 8:1, about 9:1, or about 10:1. In some embodiments, the molecule to molecule ratio of VSP carrier to therapeutic agent (VSP:therapeutic agent) is higher that 10:1. In some embodiments, the molecule to molecule ratio of VSP carrier to therapeutic agent (VSP carrier:therapeutic agent) is about 1:2, about 1:3, about 1:4, about 1:5, about 1:6, about 1:7, about 1:8, about 1:9, or about 1:10. In some embodiments the molecule to molecule ratio of VSP carrier to therapeutic agent (VSP:therapeutic agent) is lower than 1:10.

In some aspects, the VSP carrier and the therapeutic agent are co-administered, i.e., they are administered simultaneously to the subject, so they combine at the time of administration. In some aspects, the VSP carrier and the therapeutic agent are combined prior to administration. In some aspects, the combination of VSP carrier and therapeutic agent can take place at least about 1 minute, at least about 2 minutes, at least about 3 minutes, at least 4 minutes, at least about 5 minutes, at least about 10 minutes, at least about 15 minutes, at least about 20 minutes, at least about 25 minutes, at least about 30 minutes, at least about 45 minutes, at least about 1 hours, at least about 2 hours, at least 3 hours, at least about 4, or at least 6 hours prior to administration. In some embodiments, the VSP carrier and the therapeutic agent are combined at least 1 day, at least 2 days, at least 3 days, at least 4 days, at least 5 days, at least 6 days, or at least 7 days prior to administration. In some embodiments, a VSP carrier and a therapeutic agent are combined in a stable form that can be used days, weeks or months after combining the VSP carrier and the therapeutic agent.

VSP as an Insulin Carrier

In certain aspects, a VSP carrier can be combined with an insulin for oral or mucosal administration to a subject.

As used herein, the term "insulin" comprises insulin analogs, natural extracted mammalian insulin (e.g., human insulin), recombinantly produced mammalian insulin (e.g., human insulin), insulin extracted from bovine and/or porcine sources, recombinantly produced porcine and bovine insulin, insulin produced in transgenic animals, and mixtures of any of these insulin products. The term is intended to encompass the polypeptide normally used in the treatment of diabetics in a substantially purified form, but encompasses the use of the term in its commercially available pharmaceutical form, which includes additional excipients. The insulin used to combine with a VSP carrier can be recombinantly produced and can be dehydrated (completely dried) or in solution.

The term "insulin analog" refers to any form of "insulin" as defined above, where one or more of the amino acids within the polypeptide chain has been replaced with an alternative amino acid and/or where or more of the amino acids has been deleted or wherein one or more additional amino acids has been added to the polypeptide chain or amino acid sequences, which act as insulin in decreasing blood glucose levels. In general, the term "insulin analogs" includes, e.g., "insulin lispro" analogs as disclosed, e.g., in U.S. Pat. No. 5,547,929, which is herein incorporated by reference in its entirety; insulin analogs including LysPro insulin and Humalog insulin and other "super insulin" analogs, wherein the ability of the insulin analog to affect serum glucose levels is substantially enhanced as compared with conventional insulin as well as hepato selective insulin analogs which are more active in liver than in adipose tissue. The term "insulin analogs" also includes chemically and enzymatically modified insulins (e.g., mammalian insulins chemically converted into human insulin), NPH insulin (e.g., the intermediate-acting isophane insulin), insulin aspart, insulin glulisine, insulin glargine, insulin detemir, insulin degludec, etc.

In some embodiments, insulin analogs are monomeric insulin analogs, which are insulin-like compounds used for the same general purpose as insulin, such as insulin lispro, e.g., any compounds which are administered to reduce blood glucose levels.

"Insulin analogs" are well known compounds. Insulin analogs are known to be divided into two categories: animal insulin analogs and modified insulin analogs (pages 716-20, chapter 41, Nolte M. S, and Karam, J. H., "Pancreatic Hormones & Antidiabetic Drugs" In Basic & Clinical Pharmacology, Katzung, B. G., Ed., Lange Medical Books, New York, 2001). Historically, animal insulin analogs include porcine insulin (having one amino acid different from human insulin) and bovine insulin (having three amino acids different from human insulin) which have been widely used for treatment of diabetes. Since the development of genetic engineering technology, modifications are made to create modified insulin analogs, including fast-acting insulin analogs or longer acting insulin analogs. Several insulin analog molecules have been on the market prior to the filing date of the subject application. For example, Eli Lilly markets a fast-acting insulin analog called "lispro" under the trade name HUMALOG® and Novo Nordisk sells another fast-acting insulin analog called "aspart" under the trade name NOVOLOG®. In addition, Aventis markets a long-acting insulin analog called "glargine" under the trade name LANTUS® and Novo Nordisk markets another long-acting insulin analog called "detemir" under the trade name LEVEMIR®. Table 41-4 of the Nolte and Karam (2001) reference cited above provides a non-limiting list of the wide range of types of molecules generically referred to as insulin.

The term insulin also encompasses insulin as defined above covalently coupled to one or more heterologous moieties that can improve pharmacokinetic and/or pharmacodynamic properties over native insulins, e.g., PEGylated insulins (see, e.g., U.S. Pat. No. 6,890,518). See also, U.S. Pat. Nos. 7,049,286; 7,470,663; 6,890,518; and U.S. Appl. Pub. Nos. US2008/0139784; US2011/0281791; US2009/0036353; US20110020871; US2009/0239785.

VSP as a Glucagon Carrier

In certain aspects, a VSP carrier can be combined with glucagon for oral or mucosal administration to a subject.

As used herein, the term "glucagon" comprises glucagon analogs, natural extracted mammalian glucagon (e.g., human glucagon), recombinantly produced mammalian glucagon (e.g., human glucagon), glucagon extracted from bovine and/or porcine sources, recombinantly produced glucagon, glucagon produced in transgenic animals, and mixtures of any of these glucagon products. The term is intended to encompass the polypeptide normally used in the treatment of hypoglycemia (?) in a substantially purified form, but encompasses the use of the term in its commercially available pharmaceutical form, which includes additional excipients. The glucagon used to combine with a VSP carrier can be recombinantly produced. In some embodiments, glucagon can be dehydrated (completely dried) or in solution.

VSP as a Growth Hormone Carrier

In certain aspects, a VSP carrier can be combined with a growth hormone, e.g., human growth hormone, for oral or mucosal administration to a subject.

The terms "growth hormone (GH)" refers generally to growth hormones secreted by the pituitary gland in mammals. Although not an exhaustive list, examples of mammals include human, apes, monkey, rat, pig, dog, rabbit, cat, cow, horse, mouse, rat and goat. In some embodiments of the present invention, the mammal is a human.

The terms "human growth hormone" and "hGH" are used interchangeably and refer to a protein having an amino acid sequence, structure and function characteristic of native human growth hormone. As used herein, hGH also includes any isoform of native human growth hormone, including but not limited to, isoforms with molecular masses of 5, 17, 20, 22, 24, 36 and 45 kDa (see, e.g., Haro et al., J. Chromatography B, 720, 39-47 (1998)). Thus, the term hGH includes the 191 amino acid sequence of native hGH, somatotropin, and the 192 amino acid sequence containing an N-terminal methionine (Met-hGH) and somatrem (see, e.g., U.S. Pat. Nos. 4,342,832 and 5,633,352). hGH can be obtained by isolation and purification from a biological source or by recombinant DNA methods. Met-hGH is typically prepared by recombinant DNA methodology.

The term "human growth hormone" also encompasses human growth hormone derivatives. The term "human growth hormone derivative" refers to a protein that differs by at least about 1% but not by more than about 20% from the amino acid sequence of the 191 amino acid sequence of hGH or the 192 amino acid-sequence of Met-hGH. For example, the derivative can differ by about 1% to about 20%, about 2% to about 15%, or about 5% to about 10% from the 191 amino acid sequence of hGH or the 192 amino acid-sequence of Met-hGH; the protein can differ by about 1%, about 2%, about 3%, about 4%, about 51%, about 6%, about 7%, about 8%, about 9%, about 10%, about 11%, about 12%, about 13%, about 14%, or about 15% from the 191 amino acid sequence of hGH or the 192 amino acid-sequence of Met-hGH. The differences between the derivative and the 191 amino acid hGH or the 192 amino acid Met-hGH amino acid sequence can be one or more substitutions (e.g., conservative or non-conservative substitutions), deletions, additions (e.g., insertions or amino- or carboxy-terminal additions)), modifications, or combinations thereof.

In some embodiments, an hGH derivative maintains a biological activity and/or a chemical and/or physical property of the 191 amino acid hGH or the 192 amino acid Met-hGH amino acid sequence. Likewise, in some embodiments, a formulation containing a derivative (e.g., a formulation of poly-Arg complexed crystalline hGH derivative) possesses a chemical and/or physical property of a similarly-prepared formulation containing the 191 amino acid hGH or the 192 amino acid Met-hGH amino acid sequence (e.g., a formulation of poly-Arg complexed crystalline hGH).

In various embodiments of the present disclosure, human growth hormone derivatives comprise organic cations of hGH or Met-hGH, substitution, deletion and insertion variants of biologically synthesized hGH or Met-hGH proteins, post-translationally modified hGH and Met-hGH proteins, including—without limitation—deamidation, phosphorylation, glycoslylation, acetylation, aggregation and enzymatic cleavage reactions (see, e.g., Haro et al., J. Chromatography B, 720, 39-47 (1998)), chemically modified hGH or Met-hGH proteins derived from biological sources, polypeptide analogs and chemically synthesized peptides containing amino acid sequences analogous to those of hGH or Met-hGH. Methods used to prepare hGH or Met-hGH include isolation from a biological source, recombinant DNA methodology, synthetic chemical routes or combinations thereof. Genes that encode for different DNA sequences of hGH include hGH-N and hGH-V (see, e.g., Haro et al., J. Chromatography B, 720, 39-47 (1998); Bennani-Baiti et al., Genomics, 29, 647-652 (1995)). hGH is commercially available in lyophilized form and is typically produced by recombinant DNA methods.

Production of VSP Carriers

Recombinant expression of the VSP carriers can be achieved through the construction of an expression vector containing a polynucleotide that encodes a VSP carrier. Once a polynucleotide encoding a VSP carrier has been obtained, the vector for the production of the VSP carrier can be produced by recombinant DNA technology using techniques well known in the art.

Methods for preparing a protein by expressing a polynucleotide containing a VSP carrier-encoding nucleotide sequence are known in the art. Methods that are well known to those skilled in the art can be used to construct expression vectors containing VSP carrier coding sequences and appropriate transcriptional translational control signals. These methods include, for example, in vitro recombinant DNA techniques, synthetic techniques, and in vivo genetic recombination. The disclosure, thus, provides replicable vectors comprising a nucleotide sequence encoding a VSP carrier operably linked to a promoter.

An expression vector can be transferred to a host cell by conventional techniques and the transfected cells can then be cultured by conventional techniques to produce a VSP carrier. Thus, the invention includes host cells containing a polynucleotide encoding a VSP carrier, operably associated with a promoter. Suitable host cells include, but are not limited to, microorganisms such as bacteria (e.g., *E. coli* and *B. subtilis*), fungal cells, mammalian cells, or insect cells.

A variety of host-expression vector systems can be utilized to express the VSP carrier of the present disclosure. Such host-expression systems represent vehicles by which the coding sequences of interest can be produced and subsequently purified, but also represent cells which can, when transformed or transfected with the appropriate nucleotide coding sequences, express a VSP carrier in situ. These include but are not limited to microorganisms such as bacteria (e.g., *E. coli* and *B. subtilis*) transformed with recombinant bacteriophage DNA, plasmid DNA or cosmid DNA expression vectors containing VSP carrier coding sequences, fungal cell system (e.g., *Saccharomyces* or *Pichia*), mammalian cell systems (e.g., COS, CHO, BHK, 293, NSO, and 3T3 cells), or insect cell systems. Once a VSP carrier has been produced by recombinant expression, it can be purified by any method known in the art for purification of a protein.

In some embodiments, a DNA encoding a VSP carrier is codon optimized for expression in an insect protein expression system, e.g., a baculovirus expression system. In some embodiments, a VSP carrier is expressed in an insect protein expression system, e.g., a baculovirus expression system.

Pharmaceutical Compositions

In another aspect, the present disclosure provides a therapeutic composition including, but not limited to, a pharmaceutical composition, containing one or more than one VSP carrier combined with one or more than one therapeutic agents, formulated together with a pharmaceutically acceptable excipient. Such compositions can include one or a combination of two or more different VSP carriers. For example, a pharmaceutical composition can comprise a combination of VSP carriers that bind to the same therapeutic agent or to more than one therapeutic agent. These therapeutic agents can have complementary activities. In a specific aspect, a pharmaceutical composition comprises a single VSP carrier. In a specific embodiment, a pharmaceutical composition comprises more than one VSP carriers.

Pharmaceutical compositions comprising one or more VSP carriers also can be administered in combination therapy. For example, the combination therapy can include a pharmaceutical composition which comprises at least one VSP carrier combined with at least one therapeutic agent, combined with at least one other therapy wherein the therapy can be immunotherapy, chemotherapy, radiation treatment, or drug therapy. Pharmaceutical compositions of the invention can include one or more pharmaceutically acceptable salts.

Examples of suitable aqueous and non-aqueous carriers that can be employed in contemplated pharmaceutical compositions of the invention include water, ethanol, polyols (such as glycerol, propylene glycol, polyethylene glycol, and the like), and suitable mixtures thereof, vegetable oils, such as olive oil, and injectable organic esters, such as ethyl oleate. Proper fluidity can be maintained, for example, by the use of coating materials, such as lecithin, by the maintenance of the required particle size in the case of dispersions, and by the use of surfactants.

In another aspect, pharmaceutical compositions comprising a VSP carrier can also contain agents such as preservatives, wetting agents, emulsifying agents and dispersing agents. Prevention of presence of microorganisms can be ensured both by sterilization procedures and by the inclusion of various antibacterial and antifungal agents, for example, paraben, chlorobutanol, phenol sorbic acid, and the like. It can also be desirable to include isotonic agents, such as sugars, sodium chloride, and the like into the compositions. In addition, prolonged absorption can be brought about by the inclusion of agents which delay absorption such as aluminum monostearate and gelatin.

Pharmaceutically acceptable carriers include sterile aqueous solutions or dispersions and sterile powders for the extemporaneous preparation of sterile injectable solutions or dispersion. The use of such media and agents for pharmaceutically active substances is known in the art. Except insofar as any conventional media or agent is incompatible with the active compound, use thereof in the pharmaceutical compositions of the invention is contemplated. Supplementary active compounds can also be incorporated into the pharmaceutical compositions of the invention.

Actual dosage levels of the active ingredients in pharmaceutical compositions comprising a VSP carrier can be varied so as to obtain an amount of the active ingredient which is effective to achieve the desired therapeutic response for a particular patient, composition, and mode of administration, without being toxic to the patient. The selected dosage level will depend upon a variety of pharmacokinetic factors including the activity of the particular compositions employed, or the ester, salt or amide thereof, the route of administration, the time of administration, the rate of excretion of the particular compound being employed, the duration of the treatment, other drugs, compounds and/or materials used in combination with the particular compositions employed, the age, sex, weight, condition, general health and prior medical history of the patient being treated, and like factors well known in the medical arts.

A therapeutically effective dosage of pharmaceutical composition comprising a VSP carrier can be indicated by a decrease in severity of disease symptoms, an increase in frequency and duration of disease symptom-free periods, or a prevention of impairment or disability due to the disease affliction. A therapeutically effective dose can also prevent or delay onset of disease. Accordingly, any clinical or biochemical monitoring assay can be used to determine whether a particular treatment is a therapeutically effective dose. One of ordinary skill in the art would be able to determine such amounts based on such factors as the subject's size, the severity of the subject's symptoms, and the particular composition or route of administration selected.

Therapeutic compositions comprising a VSP carrier are particularly well suited for oral administration. Alternatively, therapeutic compositions comprising a VSP can be administered via a non-parenteral route, such as a topical, epidermal or mucosal route of administration, for example, intranasally, buccally, vaginally, rectally, sublingually or topically. Of course, therapeutic compositions comprising a VSP carrier can be administered via one or more alternative routes of administration using one or more of a variety of methods known in the art. As will be appreciated by the skilled artisan, the route and/or mode of administration will vary depending upon the desired results.

In certain embodiments, therapeutic compositions comprising VSP carriers are formulated for an oral or a mucosal administration. The doses used for the oral or a mucosal administration can be adapted as a function of various parameters, and in particular as a function of the mode of the relevant pathology, or alternatively of the desired duration of treatment.

Upon formulation, pharmaceutical compositions comprising VSP carriers can be administered in a manner compatible with the dosage formulation and in such amount as is therapeutically effective. The formulations are easily administered in a variety of dosage forms, such as the type of, e.g. tablets or other solids for oral or a mucosal administration; time release capsules; and any other form currently used. Accordingly, the pharmaceutical composition may be in the form of a spray, an aerosol, a mixture, a suspension, a dispersion, an emulsion, a gel, a paste, a syrup, a cream, an ointment, implants (ear, eye, skin, nose, rectal, and vaginal), intramammary preparations, vagitories, suppositories, or uteritories). In certain embodiments, the use of liposomes is contemplated. The formation and use of liposomes are known to those of skill in the art.

More particularly, the pharmaceutical composition is formulated so that the therapeutic agent in the therapeutic composition of the invention is resistant to enzymatic and chemical degradation of the upper gastrointestinal tract, when necessary. Moreover, in certain embodiments, a VSP carrier should be able to attach to cells, more particularly epithelial cells of the gut.

Methods

The VSP carriers of the present disclosure have in vitro and in vivo therapeutic and diagnostic utility. For example, the VSP carriers can be used to administer therapeutic agents or diagnostic reagents to cells in culture, e.g., in vitro or ex vivo, or in a subject, e.g., in vivo, to treat, prevent or diagnose a variety of disorders. A disease, a disorder or physiologic conditions considered in the invention can be, but it is not limited to, hormone deficiencies, cancers, immunological diseases, autoimmune diseases, allograft rejections, viral diseases, such as influenza or AIDS, parasitic diseases, bacterial infections, or allergies.

The present disclosure provides a method of delivering a therapeutic agent to a target location in a subject comprising the administration of a therapeutic composition comprising a VSP carrier and a therapeutic agent. In some specific embodiments of the disclosed method of delivering, the VSP carrier is the VSP1267 carrier and the therapeutic agent is a bioactive peptide such as insulin, glucagon, or hGH.

Also provided is a method of treating a disease or condition in a subject comprising administering to said subject an effective amount of a therapeutic composition comprising a VSP carrier and a therapeutic agent. In some embodiments, the disease or condition is a hormone deficiency. In specific embodiments, the hormone deficiency is an insulin deficiency. In some embodiments, the insulin deficiency is type 1 diabetes. In some specific embodiments, the method of treating the hormone deficiency comprises administering the VSP1267 carrier and a bioactive peptide such as insulin, glucagon, or hGH.

The present disclosure also provides a method of treating a disease or condition in a subject comprising combining a VSP carrier and a therapeutic agent, wherein the VSP carrier can bind to the therapeutic agent, and administering an effective amount of the combination of VSP carrier and therapeutic agent to the subject. In some specific embodiments, the VSP carrier is the VSP1267 carrier and it is combined with a therapeutic agent which is a bioactive peptide such as insulin, glucagon, or hGH.

The present disclosure also provides a method of making an orally or mucosally deliverable composition, comprising combining a VSP carrier and a therapeutic agent, wherein the VSP carrier can bind to the therapeutic agent. In some specific embodiments, the orally or mucosally deliverable composition comprises the VSP1267 carrier combined with a therapeutic agent which is a bioactive peptide such as insulin, glucagon, or hGH.

Also disclosed herein is a method of making an injectable composition suitable for oral or mucosal administration comprising combining a VSP carrier and a therapeutic agent, wherein the VSP carrier can bind to the therapeutic agent. In some specific embodiments, the orally or mucosally deliverable injectable composition comprises the VSP1267 carrier combined with a therapeutic agent which is a bioactive peptide such as insulin, glucagon, or hGH.

Also provided in the present disclosure is a method of increasing resistance of a therapeutic agent to enzymatic degradation comprising combining a VSP carrier and a therapeutic agent, wherein the VSP carrier can bind to the therapeutic agent, and wherein combining the VSP carrier and the therapeutic agent results in improved resistance of the therapeutic agent to enzymatic degradation. In some specific embodiments, the VSP carrier is the VSP1267 and the therapeutic agent is a bioactive peptide such as insulin, glucagon, or hGH.

The present disclosure also provides a method of increasing the resistance of a therapeutic agent to pH denaturation comprising combining the therapeutic agent with a VSP carrier, wherein the VSP carrier can bind to the therapeutic agent, and wherein combining the VSP carrier and the therapeutic agent results in improved resistance of the therapeutic agent to pH denaturation. In some specific embodiments, the VSP carrier is the VSP1267 and the therapeutic agent is a bioactive peptide such as insulin, glucagon, or hGH.

The present disclosure also provides a method of increasing simultaneously the resistance of a therapeutic agent to enzymatic degradation and its resistance to pH denaturation comprising combining the therapeutic agent with a VSP carrier, wherein the VSP carrier can bind to the therapeutic agent, and wherein combining the VSP carrier and the therapeutic agent results in an increased resistance of a therapeutic agent to enzymatic degradation and increased resistance to pH denaturation. In some embodiments, the combination of the VSP carrier and the therapeutic agent increases the therapeutic agent's resistance to pH-mediated degradation when exposed to a pH ranging between about 1 and about 2, or between about 2 and about 3, or between about 3 and about 4, or between 4 and about 5, or between about 5 and about 6, or between about 6 and 7, or between about 7 and about 8, or between about 8 and about 9, or between about 9 and about 10, or between about 10 and about 11, over between about 11 and about 12, or between about 12 and about 13, or between about 13 and about 14. In some specific embodiments, the VSP carrier is the VSP1267 and the therapeutic agent is a bioactive peptide such as insulin, glucagon, or hGH.

Also provided is a method of improving the attachability of a therapeutic agent to mucosal epithelial cells comprising combining a therapeutic agent with a VSP carrier, wherein the VSP carrier can bind to the therapeutic agent, and wherein combining the VSP carrier and the therapeutic agent results in improved attachability of the therapeutic to mucosal epithelial cells. In some specific embodiments, the VSP carrier is the VSP1267 and the therapeutic agent is a bioactive peptide such as insulin, glucagon, or hGH. In some embodiments, the mucosal epithelial cells are intestinal epithelial cells. In other embodiments, the mucosal epithelial cells as gastric epithelial cells. In other embodiments, the mucosal epithelial cells are oral epithelial cells. Mucosal delivery, i.e., delivery of a therapeutic agent to mucous tissue by a VSP carrier refers, e.g., to delivery to bronchial and other respiratory tract mucosal tissues, gingival, lingual, nasal, oral, gastrointestinal, and genitourinary tract mucosal tissues.

The invention also provides methods of using VSP carriers in diagnostics. In some embodiments, a VSP carrier can be combined with one or more than one diagnostic reagents. The invention also provides methods of imaging specific targets using VSP carriers. In one embodiment, a VSP carrier is combined imaging agents such as green-fluorescent proteins, other fluorescent tags (Cy3, Cy5, Rhodamine and others), biotin, or radionuclides to be used in methods to image the presence, location, or progression of a specific target. In some aspects, the method of imaging a target comprising a VSP carrier is performed by MRI, PET scanning, X-ray, fluorescence detection or by other detection methods known in the art.

Therapies comprising the use of VSP carriers can be combined with conventional therapies suitable for the prevention, treatment, reduction or amelioration of disease or symptoms thereof. Exemplary conventional therapies can be found in the Physician's Desk Reference (56th ed., 2002 and 57th ed., 2003). In some embodiments, therapies using VSP carriers can be combined with chemotherapy, radiation therapy, surgery, immunotherapy with a biologic (e.g., an antibody or antigen-binding fragment thereof, or a peptide, e.g., a bioactive peptide), small molecules, or another therapy known in the art. In some embodiments, the combinatorial therapy is administered together with the therapy comprising the use of VSP carriers. In other embodiments, the combinatorial therapy is administered separately from the therapy comprising the use of VSP carriers.

The present disclosure also provides methods of monitoring disease progression, relapse, treatment, or amelioration using the VSP carriers. In one embodiment, methods of monitoring disease progression, relapse, treatment, or amelioration is accomplished by the methods of imaging, diagnosing, or contacting a compound/target with a VSP carrier as presented herein.

The present disclosure also provides a method to increase the solubility of a poorly soluble drug (e.g., a small molecule drug) by combining it with a VSP carrier, wherein the binding of the poorly soluble drug to the VSP carrier increases the solubility of the drug. In some embodiments, the poorly soluble drug is a small molecule drug used to treat a hormonal imbalance (e.g., an antidiabetic small molecule drug). In other embodiments, the poorly soluble drug is an antibiotic. In some embodiments, the antibiotic is an aminoglycoside antibiotic, e.g., amikacin. In other embodiments, the antibiotic is a glycopeptide antibiotic, e.g., vancomycin.

Kits

Also provided is a pharmaceutical pack or kit comprising one or more containers filled with one or more of the pharmaceutical compositions disclosed herein. Optionally associated with such container(s) can be a notice in the form prescribed by a governmental agency regulating the manufacture, use or sale of pharmaceuticals or biological products, which notice reflects approval by the agency of manufacture, use or sale for human administration. The present disclosure provides kits that can be used in the above methods of treatment and administration. In one aspect, a kit comprises a VSP carrier, preferably in a purified form, in one or more containers. In some embodiments, the kit comprises a VSP carrier combined with a therapeutic in one container. In other embodiments, the kit comprises a VSP carrier and a therapeutic agent in different containers.

Equivalents

Those skilled in the art will recognize, or be able to ascertain using no more than routine experimentation, many equivalents to the specific embodiments of the invention described herein. Such equivalents are intended to be encompassed by the following claims.

All publications, patents, and patent applications referred to herein are expressly incorporated by reference in their entireties.

EXAMPLES

Example 1

VSP Resistance to Variable pH and to Digestion by Intestinal Proteases

VSPs are integral membrane proteins of protozoan parasites, e.g., *Giardia lamblia*, with a variable extracellular region rich in CXXC (SEQ ID NO:589) motifs, a unique transmembrane hydrophobic regions and a short, 5 amino acid-long cytoplasmic tail (FIG. 1C). Each trophozoite (the active, motile feeding stage of the *Giardia* parasite) expresses a single VSP on its surface, as shown in FIGS. 1A and 1B. FIG. 1A shows phase contrast (left panel) and immunofluorescence (right panel) assays showing that, from a group of *Giardia* trophozoites only one expresses on its surface a given VSP, as demonstrated by surface labeling with an anti-VSP specific monoclonal antibody, while the other cells express a different surface protein. FIG. 1B shows an anti-VSP specific immunogold labeling of the surface of a trophozoite. It can be observed that the entire surface of the parasite is labeled, including the ventral disk and the flagella, generating a thick surface coat.

Purified VSPs are not toxic for cells when added to cultures and they are not toxic for the animals when administered by the oral route. Animals do not lose weight and have no diarrhea, which are commonly associated to *Giardia* infections (see Rivero et al., Nat. Med. 16(5):551-7 (2010)). Despite their lack of toxicity, to be useful as therapeutic agent carriers, VSPs must be able to survive the harsh conditions of the GIT.

To determine whether VSPs are resistant to variable pH and to proteolytic digestion, two different *Giardia* isolates (clonal trophozoite populations) were treated with trypsin and with variable pH and the effect of those conditions on the VSP expressed by each isolate were monitored using immunofluorescence assays.

For the trypsin resistance assay, *Giardia* parasites were resuspended in PBS at pH 7.4 and treated for 90 minutes with variable concentrations of trypsin similar of those found in the upper small intestine. Afterwards, the parasites were washed, and incubated with two monoclonal antibodies, each one recognizing the particular VSP expressed by each of the two isolates tested: the GS/M isolate and the WB isolate. The monoclonal antibody G10/4 recognized a conformational epitope in VSPH7 of the GS/M isolate. The monoclonal antibody 9B10 detected a non-conformational epitope in VSP9B10 of the WB isolate. The antibodies agglutinated the trophozoites and labeled the surface of the parasites.

It was observed that after incubation with 100 µg/ml or 200 µg/ml of trypsin, the presence of both VSP proteins was still detectable by the monoclonal antibodies, indicating that both VSPs survived trypsinization (FIG. 2A).

For the pH resistance assay, *Giardia* parasites were resuspended in RPMI cell culture medium at variable pHs, from pH 1 to pH 10, in 1 pH unit increments (only pH 1, 3, 5 and 10 are shown in FIG. 2B). *Giardia* parasites were kept at the different pHs for 90 minutes, washed, and then incubated with the corresponding monoclonal antibody. In all cases the VSP epitopes in VSPH7 and VSP9B10 remained intact as determined by immunofluorescence microscopy, indicating that both VSPs survived exposure to variable pH without undergoing chemical degradation (FIG. 2B).

Resistance to proteolytic digestion was also demonstrated using Western Blot analysis of VSPs after treating trophozoites with trypsin (FIG. 3). *Giardia* parasite clones WB-9B10, WB-1267 and GS-H7 (expressing, respectively, the VSP9B10, VSP1267 and VSPH7 VSPs) were resuspended in PBS at pH 7.4 and treated for 90 min at 37° C. with variable concentrations of trypsin (200 µg/ml and 2 mg/ml). Then, the parasites were lysed and equivalent protein amounts were applied to each lane in the SDS-PAGE gels. FIG. 3 shows that the three VSPs tested were able to survive exposure to trypsin.

These results demonstrated that VSPs are resistant to chemical and proteolytic degradation and can survive environmental conditions similar to those found in the GIT.

Example 2

VSP Attachment to Enteric Mucosa after Oral Administration

To determine whether VSPs were capable of attaching to the enteric mucosa after oral administration, in vivo assays were conducted in gerbils. A group of gerbils was infected with *Giardia* parasite clone WB-9B10 trophozoites (FIG. 4, panel A), a second group was not infected (FIG. 4, panel B), and a third group of gerbils was immunized with the entire repertoire of VSPs purified from transgenic trophozoites (FIG. 4, panel C). Tissue sections from each group were incubated with the anti-VSP9B10 monoclonal antibody, detected with anti-mouse immunoglobulins labeled with horseradish peroxidase, developed with 3,3' diaminobenzidine, and counterstained with hematoxylin/eosin.

A strong difference on the level of staining of the surface of the gut epithelial cells between infected or immunized (panels A and C) compared to non-infected animal (panel B) was observed, indicating that VSPs remained attached to the enteric mucosa after oral administration.

These results, together with the results of Example 1 indicated that VSPs survived pH and enzymatic conditions in the GIT and successfully attached to gut epithelial cells. These physicochemical properties would allow VSPs to shuttle drugs through the GIT, and the prolonged stay in the GIT should allow the passage of drugs carried by the VSPs from the GIT to the bloodstream.

Example 3

Recombinant Production of VSP1267 VSP Carrier

To obtain the VSP carrier to be used for the oral administration experiments, a modified VSP protein was designed and recombinantly produced. The full-length VSP contained a cysteine-rich extracellular region containing numerous CXXC (SEQ ID NO:589) motifs. A DNA construct in which the transmembrane region and the cytoplasmic 5 residues of the VSP1267 were eliminated and a His6 protein purification tag was added at the carboxy terminal (FIG. 5A) was generated (SEQ ID NO:1). The signal sequence is underlined in FIG. 5A. The amino acids in the His6 protein purification tag are show in a box in FIG. 5A.

Initially, the VSP carrier was recombinantly expressed in *E. coli* BL21 using the pET28 expression vector (Novagen). Protein production was subsequently improved by codon optimization of the recombinant DNA sequence for expression in baculovirus. The protein was expressed and purified by one step affinity purification using the His6 tag present in the carboxy terminal portion of the protein (FIG. 5B).

Example 4

Sensitivity of Commercial Insulins to Trypsin

To test in vitro the capacity of VSP carriers to protect bioactive peptides from degradation, the capacity of recombinant VSP1267 to protect insulin from conditions similar to those present in the GIT was evaluated. Natural Insulin is a bioactive peptide with a molecular mass of 5.8-6 kDa. Prior to evaluating the capacity of the VSP to protect insulin from in vivo degradation in the GIT, the sensitivity of two commercial insulins to proteolysis by trypsin and pancreatine was tested in vitro.

Two types of insulin were tested:
- LANTUS®: Insulin Glargine (Sanofi-Aventis). Differs from natural human insulin in that the amino acid asparagine at position A21 is replaced by glycine and two arginines are added to the C-terminus of the B-chain, MW: 6,063 kDa). It is long-acting insulin.
- NOVORAPID®: Insulin Aspart (Novo/Nordisk). Differs from human insulin in that the amino acid, B28, which is normally proline, is substituted with an aspartic acid residue). It is fast acting insulin.

The proteolytic profiles of NOVORAPID® and LANTUS® after preincubation of the insulins with trypsin at 100, 150, 200, 500 and 1000 µg/mL, and pancreatine at enzyme:substrate ratios of 1:1 and 1:2 are shown in FIG. 6. The insulins and their degradation products were visualized using silver staining. LANTUS® insulin was not easily degraded in the assayed experimental conditions. However, for NOVORAPID®, a trypsin dose-dependent increase in proteolytic degradation was observed.

Example 5

In Vivo Capacity of VSPs to Protect Insulin from Degradation

The combination of insulin with the VSP carrier VSP1267 was assayed to determine whether the VSP can (i) protect insulin from degradation when administered orally and (ii) promote its systemic biological action, namely the regulation of blood glucose levels. Accordingly, a sub-optimal oral dose of insulin was first determined, and then it was determined whether the combination of insulin at this sub-optimal dose with the VSP carrier could promote insulin's biological action (see FIG. 7).

The biological activity of insulin was measured by testing its hypoglycemic capacity. Accordingly, blood glucose levels were quantified in female Balb/c 7 week-old mice left without food intake for 2 hours. After the starvation period, the mice received 1 IU, 5 IU and 50 IU oral doses of LANTUS® (FIG. 7A) or NOVORAPID® (FIG. 7B). Blood glucose levels were determined at the indicated time points. Blood glucose levels were also quantified after the administration of an i.v. bolus of glucose, and after subcutaneous administration of 1-5 IU of insulin as a positive control. These experiments indicated that 1 IU of insulin was a sub-optimal oral dose that could be used for the follow up experiments testing the administration of insulin in combination with a VSP carrier (see FIG. 8).

The results shown in FIG. 8 demonstrate that the administration of insulin in combination with a VSP carrier promotes insulin action when administered by the oral route. In this experiment, female Balb/c mice, 7 week-old were left without food intake for 2 hours and then received doses of insulin, LANTUS® (FIG. 8A) and NOVORAPID® (FIG. 8B), at the suboptimal dose identified in FIG. 7 (1 IU) in three different formulations (i) insulin administered alone, (ii) insulin combined with VSP at a 1:1 ratio, and (iii) insulin combined with VSP at a 1:3 ratio. PBS and a subcutaneous administration of insulin at 1-5 IU were used as controls. The combination of 1 IU of insulin with VSPs enhanced insulin's biological action, at a 1:1 insulin/VSP ratio for LANTUS® and at a 1:3 insulin/VSP ratio for NOVORAPID® (circled).

Example 6

IN VITRO Protection of Human Growth Hormone (hGH) by the VSP1267 VSP Carrier To evaluate in vitro the capacity of a VSP carrier to protect bioactive peptides from degradation, we evaluated the capacity of recombinant VSP1267 to protect human growth hormone (somatotropin, hGH) (Biosidus, Argentina), a 191 amino acids long protein, from conditions similar to those present in the GIT. Similar to the previous analysis performed with the VSPs alone, the capacity of the VSP to protect hGH from degradation caused by extreme pHs or by enzymatic proteolysis was assayed.

First, the specificity of the αHCB anti-hGH monoclonal antibody was determined by Western blot (FIG. 9). Two dilutions of the monoclonal antibody αHCB (1/3000 and 1/2000), as well as a control anti-alkaline phosphatase antibody (αMouse-AP1) were used to detect hGH (HCB: human growth hormone produced in transgenic bovines). The αHCB monoclonal antibody recognized only one band of the correct molecular weight of hGH (22.1 KDa). Different amounts of hGH (0.25, 0.5, 1, 5 and 10 µg) were used. The αHCB hGH specific monoclonal antibody was capable of detecting very low amounts of hormone at very high dilutions. The anti-mouse antibody used as control showed no reaction.

The anti-hGH monoclonal antibody was subsequently used to determine the degree of resistance of hGH to different pHs. hGH was incubated at different pHs (1.6, 2.0, 3.8, 5.0, 5.8, 7.0, 8.0, 9.0, 10.0, and 11.0) for 90 minutes. The Western blot results shown in the top panel of FIG. 10A as well as the silver staining detection of the hormone shown in the bottom panel of FIG. 10A, indicated that at higher pHs hGH remained unaltered as compared with the control. The hormone suffered auto-proteolytic processing at slightly acidic pHs that did not interfere with the recognition of anti-GH antibody (see, e.g., Such-Sanmartin et al., Growth Factors 27:255-64 (2009)). However, at very low pHs (similar to those found in the stomach) part of the hormone was highly degraded (FIG. 10A, circles).

When a VSP carrier was added to hGH at a 3:1 VSP/hGH ratio and the mixtures were incubated at different pHs (1.4, 1.96, 3.8, 4.91, 5.9, 7.01, 7.95, 8.51, 9.61 and 11.17), no significant changes respect to the hGH degradation levels of hGH in the absence of VSP were observed (FIG. 10B).

hGH was also treated for 90 min at 37° C. with several concentrations of trypsin (0, 100, 150, 200, and 500 µg/ml). The Western blot results shown in the top panel of FIG. 11A as well as the silver staining detection of the hormone shown in the bottom panel of FIG. 11A indicated that the hormone was rapidly degraded even at the lowest protease concentrations. VSP addition at a 3:1 ratio was able to protect hGH from trypsin degradation (FIG. 11B). This protective effect was observed up to a 150 µg/ml trypsin concentration.

Example 7

In Vivo Protection of Human Growth Hormone (hGH) Administered in Combination with a VSP Carrier hGH serum levels were tested after oral administration, evaluating different doses and measurement times, to determine the best dose for combination with the VSP carrier VSP1267 (FIG. 11A). As in previous experiments, female Balb/c mice, 7 weeks-old, were left without food intake for 2 hours and then received the doses indicated in FIG. 12A (i.e., 50, 100, 200, 400 and 800 μg of hGH). In a parallel experiment, hGH was administered subcutaneously (FIG. 11A, inset). It was observed that hGH alone is absorbed orally, at much lower levels than subcutaneously absorption (FIG. 11A, main panel). However, this oral absorption was highly variable regarding both times and amounts. Thus, a direct relationship between absorption and these variables (time and concentration) could not be determined. Despite these results, we used a dose of 50 μg to evaluate the effect of combination of hGH with the VSP carrier.

FIG. 12 shows a time response drawing showing serum hGH levels in female Balb/c mice, 7 weeks-old, that were left without food intake for 2 hours and then received a 50 n dose of hGH in combination with a VSP carrier. Oral administration of hGH:VSP at a 1:3 ratio (50 μg of hGH combined with 150 μg of VSP) enhanced the hGH absorption when compared to the oral administration of hGH alone without a VSP carrier.

Example 8

IN VITRO and In Vivo Protection of Parathormone in Combination with a VSP Carrier Parathyroid hormone (PTH), parathormone or parathyrin, is secreted by the chief cells of the parathyroid glands as a polypeptide containing 84 amino acids. It acts to increase the concentration of calcium ($Ca^{2+}$) in the blood, whereas calcitonin (a hormone produced by the parafollicular cells (C cells) of the thyroid gland) acts to decrease calcium concentration. PTH acts to increase the concentration of calcium in the blood by acting upon the parathyroid hormone 1 receptor (high levels in bone and kidney) and the parathyroid hormone 2 receptor (high levels in the central nervous system, pancreas, testis, and placenta). PTH half-life is approximately 4 minutes. It has a molecular mass of 9.4 kDa. A low level of PTH in the blood is known as hypoparathyroidism. Causes include surgical misadventure (e.g., inadvertent removal during routine thyroid surgery), autoimmune disorder, and inborn errors of metabolism. Hypoparathyroidism can be treated, e.g., with synthetic PTH 1-34 (Tireparatide). PTH can be measured in the blood in several different forms: intact PTH; N-terminal PTH; mid-molecule PTH, and C-terminal PTH, and different tests are used in different clinical situations.

To assess in vitro the capacity of VSP carriers to protect parathormone from degradation, the capacity of a VSP carrier (e.g., VSP carrier VSP1267) to protect human parathormone from conditions similar to those present in the GIT is evaluated. The capacity of the VSP to protect parahormone from degradation caused by extreme pHs or by enzymatic proteolysis (e.g., by trypsin and/or pancreatine) is assayed using the methods described in the Examples above.

Parathormone alone or mixed with VSP carrier is incubated at different pHs or with different concentration of proteolytic enzymes such as trypsin. The presence of parathormone after the pH and proteolytic enzyme challenges is detected using an anti-parathormone monoclonal antibody.

Experimental results will show whether the combination of a VSP carrier with parathormone increases the resistance of parathormone to proteolysis and to pH-induced degradation.

In vivo assays to determine whether oral administration of parathormone in combination with a VSP carrier protects parathormone from the conditions in the GIT and results in increased absorption with respect to parathormone orally administered without a VSP carrier are performed using the methods described in previous Examples. E.g., parathormone serum levels are measured at different times after the oral administration of parathormone (alone or in combination with a VSP carrier) to mice at different doses, and parathromone/VSP ratios. The result will indicate whether absorption of parathormone and parathromone serum levels are increased when parathormone is administered in combination with a VSP carrier as compared to the oral administration of parathormone alone without a VSP carrier.

Example 9

IN VITRO and In Vivo Protection of Interleukin 2 (IL-2) in Combination with a VSP Carrier In preliminary experiments, VSP-IL-2 fusion proteins were produced in which IL-2 was genetically fused to a VSP. One of these recombinant proteins comprised a VSP C-terminally fused to IL-2. In a second recombinant construct, VSP was C-terminally rased to IL-2 via a linker interposed between the C-terminus of the VSP and the N-terminus of IL-2.

Interleukin-2 (IL-2) is an interleukin, a type of cytokine signaling molecule in the immune system. It is a protein that attracts white blood cells (lymphocytes of leukocyte), the cells that are responsible for immunity. It is part of the body's natural response to microbial infection, and in discriminating between foreign (non-self) and self. IL-2 mediates its effects by binding to IL-2 receptors, which are expressed by lymphocytes. IL-2 has been tested in many clinical trials as an immunotherapy for the treatment of cancers, chronic viral infections and as adjuvants for vaccines. A recombinant form of IL-2 for clinical use is manufactured by Prometheus Laboratories Inc with the brand name Proleukin. It has been approved by the Food and Drag Administration (FDA) for the treatment of cancers (malignant melanoma, renal cell cancer), and is in clinical trials for the treatment of chronic viral infections, and as a booster (adjuvant) for vaccines.

To assess in vitro the capacity of VSP carriers to protect IL-2 from degradation, the capacity of a VSP carrier (e.g., recombinant VSP1267) to protect human IL-2 from conditions similar to those present in the GIT is evaluated. The capacity of the VSP to protect IL-2 from degradation caused by extreme pHs or by enzymatic proteolysis (e.g., by trypsin and/or pancreatine) is assayed using the methods described in the Examples above.

IL-2 alone or mixed with VSP carrier is incubated at different pHs or with different concentration of proteolytic enzymes such as trypsin. The presence of IL-2 after the pH and proteolyitc enzyme challenges is detected using an anti-IL-2 monoclonal antibody. Experimental results will show whether the combination of a VSP carrier with IL-2 increases the resistance of IL-2 to proteolysis and to pH-induced degradation.

In vivo assays to determine whether oral administration of IL-2 in combination with a VSP carrier protects IL-2 from the conditions in the GIT and results in increased absorption with respect to IL-2 orally administered without a VSP carrier are performed using the methods described in previous Examples. E.g., IL-2 serum levels are measured at different times after the oral administration of IL-2 (alone or in combination with a VSP carrier) to mice at different doses, and IL-2/VSP ratios. Biological effects of IL-2 is assessed by monitoring in regulatory T cells numbers/frequencies as well as expression of CD25 on Treg. The result will indicate whether absorption of IL-2 and (i) IL-2 serum levels are increased, (ii) and/or Treg numbers/frequencies is increased, (iii) and/or CD25 molecule expression detected by mean fluorescent intensity of staining using flow cytometry is increased, when IL-2 is administered in combination with a VSP carrier as compared to the oral administration of IL-2 alone without a VSP carrier.

Example 10

IN VITRO and In Vivo Protection of Interleukin 10 (IL-10) in Combination with a VSP Carrier Interleukin-10 (IL-10 or IL10), also known as human cytokine synthesis inhibitory factor (CSIF), is an anti-inflammatory cytokine. In humans IL-10 is encoded by the IL10 gene. IL-10 is capable of inhibiting synthesis of pro-inflammatory cytokines such as IFN-γ, IL-2, IL-3, TNFα and GM-CSF made by cells such as macrophages and regulatory T-cells. It also displays a potent ability to suppress the antigen-presentation capacity of antigen presenting cells. However, it is also stimulatory towards certain T cells and mast cells and stimulates B cell maturation and antibody production.

To assess in vitro the capacity of VSP carriers to protect IL-10 from degradation, the capacity of a VSP carrier (e.g., recombinant VSP1267) to protect human IL-10 from conditions similar to those present in the GIT is evaluated. The capacity of the VSP to protect IL-10 from degradation caused by extreme pHs or by enzymatic proteolysis (e.g., by trypsin and/or pancreatin) is assayed using the methods described in the Examples above.

IL-10 alone or mixed with VSP carrier is incubated at different pHs or with different concentration of proteolytic enzymes such as trypsin. The presence of IL-10 after the pH and proteolytic enzyme challenges is detected using an anti-IL-10 monoclonal antibody. Experimental results will show whether the combination of a VSP carrier with IL-10 increases the resistance of IL-10 to proteolysis and to pH-induced degradation.

In vivo assays to determine whether oral administration of IL-10 in combination with a VSP carrier protects IL-10 from the conditions in the GIT and results in increased absorption with respect to IL-10 orally administered without a VSP carrier are performed using the methods described in previous Examples. E.g., IL-10 serum levels are measured at different times after the oral administration of IL-10 (alone or in combination with a VSP carrier) to mice at different doses, and IL-10/VSP ratios. The results will indicate whether absorption of IL-10 and IL-10 serum levels are increased when IL-10 is administered in combination with a VSP carrier as compared to the oral administration of IL-10 alone without a VSP carrier.

Example 11

IN VITRO and In Vivo Protection of Glucagon in Combination with a VSP Carrier

Glucagon, a peptide hormone secreted by the pancreas, raises blood glucose levels. Its effect is opposite that of insulin, which lowers blood glucose levels. Glucagon is a 29-amino acid polypeptide. Its primary structure in humans is HSQGTFTSDYSKYLDSRRAQDFVQWLMNT (SEQ ID NO:6). The polypeptide has a molecular weight of 3,485 daltons. Glucagon administration is vital first aid in cases of severe hypoglycemia when the victim is unconscious or for other reasons cannot take glucose orally. Glucagon is given by intramuscular, intravenous or subcutaneous injection, and quickly raises blood glucose levels. The reconstitution process makes using glucagon cumbersome (Meeran et al., Endocrinology 140(1):244-50 (1999); Longuet et al., Cell Metab. 8(5):359-71 (2008)).

To assess in vitro the capacity of VSP carriers to protect glucagon from degradation, the capacity of a VSP carrier (e.g., recombinant VSP1267) to protect human glucagon from conditions similar to those present in the GIT was evaluated. The capacity of the VSP to protect glucagon from degradation caused by enzymatic proteolysis by trypsin was assayed using the methods described in the Examples above.

Glucagon (1 μg) alone or mixed with VSP carrier was incubated with different concentrations of trypsin at 37° C. for 1 hour (FIG. 13A). The reaction was stopped by addition of protease inhibitor cocktail (Complete, EDTA-free, Roche Diagnostic). The presence of glucagon after the pH and proteolyitc enzyme challenges was detected using an anti-glucagon monoclonal antibody. Experimental results showed that the combination of a VSP carrier with glucagon increased the resistance of glucagon to trypsin-induced proteolysis. The top panel of FIG. 13A is a dot blot analysis showing that trypsin proteolyzed glucagon. The bottom panel of FIG. 13A shows that combining a VSP carrier with glucagon at a 1:3 glucagon to VSP ratio protected glucagon from trypsin degradation up to 1:2 (protein:protease) ratio. The Dot blots corresponded to pairs of samples in which glucagon samples without a VSP carrier, or with a VSP carrier at a 1:3 glucagon to VSP carrier ratio were subjected to the same trypsin concentrations.

The glucagon used in these assays was a polypeptide hormone of recombinant DNA origin (r-Glucagon, Lilly) marketed by Eli Lilly Company of Mexico S.A. de C.V. Predictive computer analysis (web.expasy.org/cgi-bin/peptide_cutter/peptidecutter.pl) had indicated that this peptide was sensitive to the action of the enzyme trypsin, as shown in FIG. 13A. Preliminary tests on the sensitivity of anti-glucagon antibody (Sigma-Aldrich Cat.# G2654) used in the experimental procedures described herein determined that 1 μg of this peptide was detected by the antibody.

FIG. 13B shows that VSP promotes the biological action of glucagon when glucagon is co-administered orally. Effect of oral administration of glucagon was evaluated in BALC/c mice of 7 weeks of age, which were left without food intake for 2 hs and then received the indicated doses of glucagon alone or combined with VSP. The blood glucose levels were determined at the indicated times. The combination of 50 μg glucagon with VSPs (150 μg) appears to increase the biological action of glucagon when it is administrated orally, respect to the oral administration of glucagon alone. Moreover, from the in vivo test is remarkable to note that the animals that have received an oral administration of glucagon plus VSP their glucose levels increased more quickly (15 minutes) respect to the animals with subcutaneous (S.C) inoculation (30 minutes), and the effect of the group glucagon-VSP oral was maintained greater amount of time respect to the s.c. group.

In vivo assays to determine whether oral administration of glucagon in combination with a VSP carrier protects glucagon from the conditions in the GIT and results in increased absorption with respect to glucagon orally administered without a VSP carrier were performed using the methods described in previous Examples. Glucagon serum levels were measured at different times after the oral administration of glucagon (alone or in combination with a VSP carrier) to mice at different doses, and glucagon/VSP ratios (FIG. 13B). In particular, the effect of oral administration of glucagon was evaluated in BALC/c mice of 7 weeks of age, which were left without food intake for 2 hours and then received the indicated doses of glucagon alone or combined with VSP. The blood glucose levels were determined at the indicated times. The combination of 50 μg glucagon with VSPs (150 μg) appeared to increase the biological action of glucagon when it was administrated orally, respect to the oral administration of glucagon alone. Moreover, from the in vivo test is was remarkable to observe that the animals that have received an oral administration of glucagon plus VSP saw their glucose levels increase more quickly (15 minutes) with respect to the animals that underwent subcutaneous (S.C) inoculation (30 minutes). The effect observed on the group receiving glucagon-VSP orally was maintained for greater amount of time with respect to the group receiving the composition subcutaneously.

Example 12

Delivery of Poorly Soluble Small Molecule Drugs in Combination with VSP Carriers To assess in vitro the capacity of VSP carriers to effectively deliver poorly soluble therapeutic agents (e.g., poorly soluble small molecule drugs such as glipizide, a poorly water-soluble BCS class II antidiabetic drug; amikacin, an aminoglycoside antibiotic; or vancomycin, a glycopeptide antibiotic), the capacity of a VSP carrier (e.g., recombinant VSP1267) to protect the poorly soluble therapeutic agent from conditions similar to those present in the GIT is first evaluated. The capacity of the VSP to protect the poorly soluble therapeutic agent from degradation caused by extreme pHs is assayed using methods known in the art. For example, the therapeutic agent in combination with a VSP carrier is subjected the pH levels similar to those present in the GIT, and the degradation of the drug is monitored using mass spectrometry or chromatographic methods such as HPLC. Additionally, the capacity of the VSP to solubilize the therapeutic can be measured by methods known in the art. Experimental results will show whether the combination of a VSP carrier with the poorly soluble therapeutic agent increases the therapeutic agent's solubility while protecting it from degradation by conditions similar to those present in the GIT.

In vivo assays to determine whether oral administration of the poorly soluble therapeutic agent in combination with a VSP carrier effectively keeps the therapeutic agent in solution, protects the therapeutic agent from the conditions in the GIT, and results in increased absorption with respect to the therapeutic agent administered without a VSP carrier are performed using the methods described in previous Examples and methods known in the art. The results will indicate whether combining the therapeutic agent with a VSP can maintain the therapeutic agent in solution, protect in from the conditions in the GIT, and increase the absorption of the therapeutic agent and its serum levels when compared to the oral administration of poorly soluble therapeutic agent alone without a VSP carrier.

The present invention has been described above with the aid of functional building blocks illustrating the implementation of specified functions and relationships thereof. The boundaries of these functional building blocks have been arbitrarily defined herein for the convenience of the description. Alternate boundaries can be defined so long as the specified functions and relationships thereof are appropriately performed.

The foregoing description of the specific embodiments will so fully reveal the general nature of the invention that others can, by applying knowledge within the skill of the art, readily modify and/or adapt for various applications such specific embodiments, without undue experimentation, without departing from the general concept of the present invention. Therefore, such adaptations and modifications are intended to be within the meaning and range of equivalents of the disclosed embodiments, based on the teaching and guidance presented herein. It is to be understood that the phraseology or terminology herein is for the purpose of description and not of limitation, such that the terminology or phraseology of the present specification is to be interpreted by the skilled artisan in light of the teachings and guidance.

The breadth and scope of the present invention should not be limited by any of the above-described exemplary embodiments, but should be defined only in accordance with the following claims and their equivalents.

SEQUENCE LISTING (591 sequences)

SEQ ID NO: 1 - protein, 572 aa, Giardia intestinalis
MLLIAFYLILSTFAVDCKNSGNSCEAGQCDTIGDTEICMQCNQGKVPINGICTAHSEEAVTNAGCKKNGGTNIEESDKVCGQCGNGYFLHKGGCYKIGEAPGNLICADEASNPGARTAGVCGACKDGYYKNSDAVATADSCIACEDANCATCGGAGENKCTKCIDGYFVGATGNEGGCIKCDATTGPNSYKGVAGCAKCEKPKNAGPAKCIECAADYLKTEADEQTSCVSEAVCREGKTHFPTTDSAGGNKKVCVSCGTTNNGGIENCGECTSKESAARAGTEITCTKCSSNNLSPLGDACLTDCPAGTYAVSGDSGSVCKPCHNTCAGCQTDDRETSCTACSPGYSLLYESNGATGRCVKECTGAFITNCADGQCTANVGGAKYCTQCKDGYAPIDGICTAVAAAGRDVSVCTATGGKCTACTGNYALLSGGCYNTQTLPGKSVCKAVANSNDGKCKTCANGQAPDPATNFCPLCDSTCAECSTKNDADACTKCFPGYYKTGNKCIKCTESSNNGKKIDGIPDCLSCEAPINTGPAICYVKTDGTSDDNSGNGGDSTNKSGLSTGHHHHHH

SEQ ID NO: 2 - protein, 565 aa, Giardia intestinalis
MLLIAFYLILSTFAVDCKNSGNSCEAGQCDTIGDTEICMQCNQGKVPINGICTAHSEEAVTNAGCKKNGGTNIEESDKVCGQCGNGYFLHKGGCYKIGEAPGNLICADEASNPGARTAGVCGACKDGYYKNSDAVATADSCIACEDANCATCGGAGENKCTKCIDGYFVGATGNEGGCIKCDATTGPNSYKGVAGCAKCEKPKNAGPAKCIECAADYLKTEADEQTSCVSEAVCREGKTHFPTTDSAGGNKKVCVSCGTTNNGGIENCGECTSKESAARAGTEITCTKCSSNNLSPLGDACLTDCPAGTYAVSGDSGSVCKPCHNTCAGCQTDDRETSCTACSPGYSLLYESNGATGRCVKECTGAFITNCADGQCTANVGGAKYCTQCKDGYAPIDGICTAVAAAGRDVSVCTATGGKCTACTGNYALLSGGCYNTQTLPGKSVCKAVANSNDGKCKTCANGQAPDPATNFCPLCDSTCAECSTKNDADACTKCFPGYYKTGNKCIKCTESSNNGKKIDGIPDCLSCEAPINTGPAICYVKTDGTSDDNSGNGGDSTNKSGLST

SEQ ID NO: 3 - protein, 637 aa, Giardia intestinalis
MFGSFVLAGVLVQIAWAGKATERAAQCADNTNCAEEACNVLIGGKLYCSRCNTGFVPINGQCADKEGATDQCKDGSGGDTADQTCGQCAEQTFMYKGGCYEAAQQPGQTMCQAADAGVCTQAAQGYFVPPGADASHQSVIPCGDEEGITVKNDKKYKGVLHCTRCYAPTEAADANAKAATCTACGDSKIVKTAKDSATSCVTEEECTGTKTCKTCAEGTSDGCATCEKGADGAVACKTCGSNKKVQPNKKGCIAKCPETVSAEKDGVCECVEGYVPDNAGTGCTKKPDPQCNTPGCKTCSEPKTSKEVCTECEDPKALTPTGQCIYGCEHLEGYYEGTSEGGKKACKKCEVENCLLCNGQGQCETCKDGYYKSGAACAKCNTSCKTCANGNSNGCTSCEPKQVLSYEGEGTGTCKPGCKPVSGGKDGTCKSCDLNIDGTSYCSACNVGTEYPENGVCVKKSARTASCQAEPSNGVCGTCARGFFRMNGGCYETTKLPGKSVCEEVASAGDTCQTPADGYKLNNGALITCSAGCKTCTSQDQCDTCKAGYAKTGGNTKKCVPCATGCSECNADDATKCTVCAAGYYLSKEKCIACDKSDGGSITGVANCANCAPPTNNKGPVLCYLIQNTNRSGLSTG

SEQ ID NO: 4 - DNA, 1698 bp, Giardia intestinalis
atgttgttgatagccttctatcttatattatctacatttgcagtagattgcaagaatagtggaaatagttgtgaagctggccaatgtgatacgattggcgatactgaaatctgtatgcaatgtaatcaagggaaagtacccatcaatggaatatgtacagcccatagtgaagaagcagtcactaacgctggttgtaagaagaacgggggtactaatatagaagaaagtgataaggtatgtggacaatgtggaaatggctacttcctgcacaaaggcggatgctataagataggagaggctcctggcaatctcatctgtgcggatgaggcgtcaaatcctggtgcacgtactgcaggggtgtgtggtgcttgcaaggatggctattataagaattcggatgctgttgcaactgcagactcctgtatagcatgtgaagatgccaactgtgccacatgtggaggagctggtgaaaacaaatgtacaaaatgtatagacggatactttgttggagcaactggaaatgaaggtgggtgcataaaatgtgacgctaccacagggcctaatagctacaaaggagttgctggatgtgctaaatgtgaaaagccaaagaacgctggtcctgcaaagtgcattgaatgtgctgctgattatttgaaaacagaagcagatgaacaaacgtcttgcgttagcgaagccgtgtgcagagaaggcaagacgcacttccccactactgacagcgctggtggtaacaagaaggtatgcgtaagttgtggcacaacgaataatggcggcatagaaaactgtggagaatgcacctctaaggaaagcgctgcacgggcagggacagagatcacctgcaccaaatgctctagcaataatctgagccccctgggagacgcgtgtctaacagactgccctgccggaacgtatgccgttagtggcgacagcggcagtgtctgcaagccctgtcacaacacgtgcgccggctgccagaccgacgacagggagacttcctgcacggcctgctcccctggatactcccttctgtatgagtccaacggagcaactgggaggtgcgtcaaggagtgcactggtgcgttcattaccaactgtgcggacgggcagtgcacggctaacgtcgggggtgcgaagtactgcacccagtgcaaggacgggtacgccccgatcgacgggatctgtacagcggtggcagctgccgggagagacgtgagcgtgtgcacggccacaggtggcaagtgcacggcatgtacaggcaactatgcgttattatcaggtggatgttataacacacaaacacttcctggaaagtcagtatgtaaagccgtggctaatagcaatgacgggaaatgcaaaacatgtgccaatggtcaagcaccagatcctgctactaatttctgcccattgtgtgattcaacttgtgcagaatgttcaactaaaaatgatgctgatgcttgtacaaaatgttttccaggatactataaaacaggaaataagtgtatcaaatgtacagaaagtagtaataacggaaaaaagatcgatggaatacctgattgtttaagttgtgaagcaccgattaatactggtcctgccatctgctacgttaaaacggatggcactagcgatgataacagcggcaatggtggagacagcaccaacaagagcggcctttccactggc

SEQ ID NO: 5 - DNA, 1908 bp, Giardia intestinalis
atgtttggcagttttgttctcgcgggggtactcgtccagattgcatgggcaggaaaagcaacagagcgcgcggctcaatgcgcagataacactaattgcgcagaggaagcatgcaacgttctgatcggtggtaaattgtattgctctcgatgtaacacaggatttgttcctatcaatggacaatgtgcagacaaagaaggtgcaacagatcagtgcaaagatggctccggaggcgatacagctgatcagacctgtggacagtgcgccgagcagactttcatgtacaagggcggctgttacgaagcagcccagcagcccggacagaccatgtgtcaggcggcagatgctggagtatgcacacaagccgcgcaaggatacttcgtgccgccgggcgcagacgcctctcaccaatcggtcataccatgcggagacgaagagggaataacagttaagaacgataaaaagtacaagggcgtgctgcactgcactcggtgttacgctcccacagaagcagcagatgctaacgccaaggccgccacgtgtactgcgtgcggcgatagcaagatcgtcaagacagccaaggactcagccacctcctgcgtgacagaagaagagtgcaccggcaccaagacgtgcaagacgtgcgccgaggggacctccgacgggtgtgcgacgtgcgagaagggcgccgatggagcagtcgcctgcaagacgtgcgggtctaataagaaggtccagccaaacaagaaggggtgcatagcaaagtgcccggagacggtgagtgccgagaaggatggcgtttgtgagtgcgtcgagggctacgttcccgacaacgcgggcaccgggtgcacgaagaagcccgacccccagtgcaacacccccggctgcaagacgtgcagtgagccgaagacaagcaaggaggtgtgcacagagtgcgaagaccccaaggccctcacgcccacgggccagtgcatctacggttgtgagcacctggaaggctactacgagggcaccagcgaggggggcaagaaggcctgcaagaagtgcgaggtcgagaactgcctcctgtgcaacgggcaaggacagtgcgagacctgcaaggacgggtactacaagagcggagccgcctgtgccaagtgcaatacctcgtgcaagacgtgcgcgaacgggaactccaacgggtgcacgagctgcgagcctaagcaggtcctcagctacgaaggagagggcacggggacgtgcaagccaggctgcaagccagtgagcggcggcaaggatggaacgtgcaagagctgcgacctgaacatagacgggacaagctactgttctgcctgtaacgtgggcacggagtatccagagaacggcgtgtgcgtcaagaagtcggcccgcacagcctcctgccaggcagaaccgagcaatggtgtgtgcgggacatgtgcaaggggcttcttccgcatgaacgggggctgctacgaaacgaccaaactccctggaaagagcgtctgtgaggaggtagcatcggccggcgatacctgtcagactccggccgacggatacaagctgaataatggcgcgctcatcacttgctcggccggatgtaagacgtgcaccagccaggaccagtgcgacacgtgtaaggctggatatgctaagactggcggtaacactaagaagtgcgttccctgcgccactgggtgctccgagtgcaatgcggacgacgccaccaagtgcacggtgtgcgctgcagggtactacctgtccaaagaaaagtgcatagcatgcgacaagagcgacggcggatccatcaccggcgtcgccaactgcgccaactgcgctcccccaaccaacaataaagggcctgtcctctgctacctcatacagaacaccaacaggagcgggctttccacg

SEQ ID NO: 6 - protein, 29 aa, Homo sapiens
HSQGTFTSDYSKYLDSRRAQDFVQWLMNT

SEQ ID NO: 7 - protein, 1456 aa, Paramecium tetraurelia
MSNFLFTINLIFMNCLLTWSCDPGQFDDSGQCKNCISNCLSCSNDYSCGTCKTAYYVVPIINLCDSCQNGCQVCSLVSCATCPPTFKKKSCSLCYPGYYLSGGNCSTCPIQCKTCTSNTVCQTCADHNLLIGTFCSVCDASCKNCETTTTTCTSCDPGKYLSGSSCLTCSSPCSECIDASTSCTACIDSKKTAVNYQCVCADGYYTDGSNQCQSCTAPCSKCEYNATNCTDCVSTFTLSTTTLYQCDCSPGYFYVDPQTCQACVSPCETCQLNQNHCLSCIDPNSTVNNSNQCVCNSGWLLDADGETCTKCVLPCVECEDTINKCVTCQDQAHQSPDTCVCEPGWIFDTNYYCIQCQQPCKTCEISTSQCLACFDINQEVNTSKQCVCKSTYYADSPITCAKCQQPCYECDTNGCINCIDVNQILDINKQCICKPGYVQSGYVCLQCLNPCATCINAINQCLTCVDPNQIVQNFKCLCKEGFVKKGNYCCDEYCSDCQGVDSCNSCIKGYFLTNINRCLKCIDYCDICYDQSVCQTCQEGYFINQQFQCEACVSSCKICGDPQICDVCFDGYYLLDQKCEACNQNCLTCNEVSEKCLTCRPNYEINSKDQCICKFGYYEEQNQCYKCEYPCKKCLSKSICSECFQLSNLHLDENAQCKCSPGYFWKENNCSQCHQSCLTCIDDKFNCLTCDQKLHRTLKNHKCLCAQDYFESEDALCISCLTDQGKSQEICKYSDCNDKIWTYGEQCDDGNDVIRDGCSNCKIDHNYSCSNEILKQSICFQCSTHCIQCQLDPLTKKSKCNKCEVGYFLDKNDCVECSINCLECLDQAYNCVSCRFPQQKNHKCQLCESGYLADEENGTCLNICGDQIKVKEEECDDGNKIKGDGCDNYCKLESKYIFVNGVSIVPNYPKPLLQSVGSSQVYSVTRLFKLYYITPIVIKEGFQIKDYLTFHISNSLGVQQMDQSIQLTQDTSQINEFNQSEFSLMINITFSRGSQDENLLVKFLNKSVIYSNEGYSQIETEVSCLIPKIIFIDDAAIAQVQMATKSNSYVLYFIGAMCGGSVIFGGVEVFFNLLDTLQMLSYLKYLNTQLPYNLQTYFELFGFAQFNFIQKIFDFSGFIDEILDTQQMKKIPTKVASDEVTSLFIINSATIATVWLSLFGIYAIAKVIPKILYSIKFKFYSESQTENTRLVQIGVYFLTVKFVINRLCFMIIQEFFYSGILRAHMATAYDFTFSVVLQLYALELNSSNLFVRFSSLLACVASSIYIYTIYFVIKISQMKNYALNNQEVQAKYGSIFDGIKKNQFSKYLNAILLIKKLIFMLLLIFAYDFPTFQTISIMLLSISMSLFYIFFNPIEDKLEYFKQLFSEVSISCTLLNITILTCEYELDYFTYEIRQYFGWSCIFCMTAILFIQLGIDGFQQWRYIFQKYKQIRKIAQLILGVFQGNRQVPASSNIFQ

SEQ ID NO: 8 - protein, 4719 aa, Paramecium tetraurelia
MNLKKSLFLCVLLTIVVKGDTAINQPSNTDQGLNSNNPQFACTKGNGCFAQQGLTLMDRSVCHASRQLEGIVLAQVQIHAIMQHVRMDIIKSDQLVLNTLIPTVQEEVFQQTAQPQCVSNAMGNRLKQVEYVFKITIVKPLVQALVSALFVPMDITMYSQPTLQMNSMEHKLLLTTPPISKALTLVCLAISIVQPANRSIISCSSLFSTYCNSCVKGYYLNNNQCLRCQDKLTKCNACPDETKCTECAVGSYLSNGSCILCTTLDQNCSACSDSSTCTSCVSAAYYTSGQQCIQCSDTISYCKQCSSGQNCTKCTTGFYLKSGACFLCSTQMVSCMTCSDGNTCTSCSDGTFLDGTKCSKCTLAVSNCEYCLNGTTCTTCKPKYYLNKNACNACSNSCENCINSSTNCTSCSSGYFLNGATNTCDLCDANCLTCLSAAKTCTSCVPGYFKDGDKCTECSNKCFTCVESATKCTACYVGRYFNNNNCLPCSNTCTDCETSATECTACSKGSYLNSNTCSVCSITCQECKDSATNCTKCYDGKYLNTNQCITCEFPCVNCLSKTECQSCVPGYYLSNTDCVKCAYPCSTCGTDGKCTDCVAGYEYDGSNCQICLKPCTTCQSSQNGCQSCVVGYYQHDNTCSQCSNECAGCITSATNCTSCYAGTYLNSNTCAQCTSPCATCKDSATSCRSCVQGFFYTGDPNYTCTACSKSCVACTVDANTCSSCQSGYFKSGGADGPCNACTSPCSTCSTQANSCDSCVDGYYQSSTTTCDLCKAPCAKCVNNQDKCTGCVYGYYYSENNNSCTQCTLPCTNCVASLTDCQACVQGYYLSAPGTCTECPVNCTACDSATSCTGCVDGYYVNGSKVCTLCAAQCAKCSDANNCTGCDIGFFLDKTNPNAVTCTKCTNPCYGCVDNATKCTVCDSGLVLDDVNHTCNQCSPECTSCSQSDPKNCQSCSPGYYYNNNNQCLQCSNLCKTCSQNDKNYCTACYDGFYQPTGQNTCKVCIEPCKTCKNSTSGDQCLSCYSGDFWDDTNFLCKQCQYPCVSCTNLTTCKTCEKGYFLTDPNTPGTCNICDANCDACEKTSTKCTACPNGYYVSSTNICIIYTKCTGTECVSGYYMDSNSNCVQCASICLTCNASGNNACLSCPSGSYLNAATCTKCPNNCTGCTYNSATSSVECSSCVTGYYVNNKQCTICANQCLECETTANNCTNCDTGFWKNTSLASDQCQPCLYICKTCDTAANSCQNCIDGYYPNNNACSVCPLSCTKCTAADNCTDCASGYYKNQVDATHYNCLQCVSPMVTCESASTCTTCMTGYVCNSGSCDQCSYACSTCSGNPTTCESCVPGFVKMADNTCKACTFPCLTCTGEDQTKCDSCPPGYYPNNNSCSQCPKACLTCSDQNTCTSCIDGFYKNGAACTQCQLPCLQCTTQTACKTSCIDGYFLSGTTCSACPNNCLKCSSTDPGNCSSCITGYHLDSGDCKSCSLVSPSCLECPDSKTECSKCLGGYYPDNNTCEKCTSNCLLCTKASCTTCLPGYYPNGTTTCQQCTKPCNVCNSATECTDCGDGFFLNASKECQECSAVGCLKCPSDTCDTCSTQLINDNTCSQCQLPCATCKSTGPTKCQTCVTGFYITTDTCNVFVFPCNSYSSDGNGTCQDCFAGYYLDNSNACQPCNANCKVCSNQSASHCTSCQDGYFPSSNQCQPCSASCTTCVTSDTNCQVCATGYYPSATLPATCNKCPDKCTTCTDSNTCQGCRPGFIKNGSSCDQCTSHCLTCDPDVSTCDSCIPGFYQTSSTCTQCKVGCLACDDDTTCTACWSSYYKSGSNCKNDCSGDCATCTYSNEVQTCLTCTAANKYPDPANPGQCKACVPGDDCSRNCVENCTTDQPECENNGGYYNAGPACTKCTAPCKNCTGNGTTCTSCVDGSYGADCSSTCNSSCKACTDTGVDKCSSCYDGFYLADPSPNSCNRCTNNCLTCSNSTTCLTCIPGYYPDLPNCTQCQYPCLTCTGVSTCQTCASGFHVNGSNACVSCDVGCDICSSSVCSKCSKGYYGDGNPSCTKCTFPCLECTSSTACTKCFQGYNLNGNDCEQVSTGCQVWTTDGTTSTCQTCYDGFYPNNKACSKCPNFCTTCTSNTSCGPCLTGSYKNGTNTCTQCVKGCTTCDSATVCTDCIDGFYKQANDVCQECPQKCVKCSDSSTCSECLVGYYLNGNACTECASPCKQCALDGTVKCSACDSGYQIQNDACKQCPDFCQTCDVSFKCTLCIDGYFQDSGDGSCKQCITACNKCSALDTCDTCQVGYYYNSGAKQCSQCQRGCNVCDSTQCTSCVNGYYAVANQQCQQCPSPCRTCNDTTGSCKDCVDGYYFNSPNCTECQSPCIKCSGAGNNCQACEDGYYLNGGSCTECPTQSVCQKCAVDAGDSTLKCTACAAGFFIDSANSYVCRPCDTACTACTTGAKVCQSCIQGYYPANDKCQQCSLACKICSDANTCTDCSNGYYLTGQSCNQCSLNCKYCNSSTSCKTCVDGAFIENDQVTCTLCSGKCATCINSSTNCLSCIPGYYGTPTCSSQCSNSCLYCQNSTTCSKCLPGYYLDNSNACQPCDNTCTTCSNNSATYCLSCTTGYFFNNNSCEQCQSPCTACAVSADACSGCQPGFALINSKCEQCDAICKTCSTSKSNCDSCYDGYYKNNGTCNQCAEPCTKCTYTDPGPAQCSACPDGYFLSNNVCAECKEPCKKCETAGDQCINCLDGFYKDPNNPKCPVCNSPCVTCNTDGDTCDSCIPGYYYDTTQNPAKCVQCTTPCLTCSYSATAGAVVCNTCISGYFYDTSQTPAVCTPCQTPCASCENSATECRSCNDSAFHLTTTPPLTCTQCTDPCKTCNAVTTECTDCLDGYFLPSGQTTCSECASPCLTCSPDANTCQSCIDGYYRNGNACNICQKPCNKCVDSQTKCTSCITGYYLNVNTCIQCTSPCADCTDTACLGCIKGYFWDGTKCIQCSTACTACKTSATTCSSCAPGYFLNGTGDGCNPCQTPCKECVTSATQCTSCFTGLYKNGSGAGATCTYCPSPCIICDDQNTCTTCAVGYSLKTSDHQCYQCQTPCLTCLTSASECDKCVDGYYKDGVNCTICANPCATCNGAGTNSCLSCDDGFYLNGSTCTTCVLPCLTCSSSALCKSCGDGYFLDGSQACTVCSNNCVTCVDSAGKCKSCIAGYYLDGNNTCQQCNNPCKTCENTAGNCKSCPSAYFQDGTTCTACQYPCFNCNNPANSCSSCVDGYYISGTNCNQCPDPCAKCTDQNTCTGCLAGYYYDGSQCQQCLYPCTICSSQSVCTGCDSGQYVNNNTCAKCNSNCLTCAVTDVTCVTCLTNMYLKADNTCDKCTLPCATCDTSATKCNSCITGYYLSGSTCQLCFSSIINCATCDNGSTCKTCTPGFYLSGNLCLPCSTSVDACRTCQINQSTYSCTACTVGLFLDVSTCSKCQDTNCLTCSTTSSACTQCLTGYFLDNGACTQCKSNCTSCTSSSTCTSCLVGYQLSNDSCNKCNDTKCTSCVNSVSECSLCIIGYYLTASGCSACPSGCAACTNSSTCSSCLTGYYLSNNQCNQCSSDINGCLSCLSNTKCTACDLTYYLKNQSCTTCVAGCNVCTNDTQCIVCTTKWYLDSNKTCTKCPSECATCSSGSVCLTCEANYKLQNSNCIKCTGYSNQCSECANDLCSNCVSGYTLLANNTCASCPQNCATGCTKNTQQGSSYSTICAVCQDTFYLNENSQCNSCNTGGNFALRCTYDSKTKVITPTQCINNYFLVNNQCYQAQTSNTCSKLFQPNDGTQINSQLCSDCWPSYLQSNQICYKCANCADNSCSLDQNNKPVCSSCANYYYSDSSATCQLCIANCIKCTGTGIDNCSQCDTGYYKSSNSCVACTTDSSSKSTCLSCSNETTCSTCINGYYESNGSCLACQFGCSQCVSPGNVCSGCISGYFLQNGGCVKDQGNCLENQQNQNNGCYVCAYGFYPINGWLSQQGQSQIIDNSCVQCVYPQAAFVCRSNPSDNQVQSANFGSVASGKNSNYFKSAAPLSTTRQTTPQCKSGSFWTGQSCMPCPTVNNGICQTCNNFTSCTQIQCNPLYYLITIKNVQQCVPIPTGCTDMQYSDKLMSLACSKCSSGYTLIGNICIAINGCLTIDQNSGACTQCTNGYYFNWDFILQTSKSTLTTNTNYYQYFNPFCSKCNTGCATCPSLYTCTQCLPGYFWYQSTLTTNSYSFKIYANSQTNASGQCVACPKNCQTCSSATVCTTCNTNFTVDPNSTNGDCICSSPYTYNQSNQSCSTSTANSICSFGGCAQCNSDNTQCQVCSPQYALTSQTTCTQCLNCNLCTTQPGNSNPTCTECADGYYKVQAYDGAPITCSLCSSSLNNALRCQGVLENQTQLTIIQCADNYFLFGNACYQASNSNCFTIANSNSQNCQQCLPGYTLYGNNCDQCNTKIINCSTCIQNSDQSGLTCQQCINGYVLNTNTNSCQQCPSGCQNCTIIGSTAPYTMQCSTCANGNYIDINGNCQGCPYDCKTCDSKYTCSTCNDGFYLVQSSITFNSKSYAFKPCYPCQNNCGTCTGPSGNICLTCSAGFVLQNGGCVDLTQKIQNDSNTYSLANCYTSDSTGCTVCQAGFFLDQQRVCQECVSPYNNFVCGIKAVSPTNPSNPNDNSNSSNTDTPIPIGDTPIQPTSKYGLMFGILILIVTN

SEQ ID NO: 9 - protein, 630 aa, Paramecium tetraurelia
MFAQARECHIHAKLNIFGQDRRAYLARKDASVVLIWVVMEDYNVKVDGHIKMKETRNVCNAQQDVVHVFQMGQMDLFVISANQDINQQVECGSIFVANICVPLSFNPRLGNVKFFGFGLWGIPYWTIALDNLPQGIEEAYSTLDCIERDSSTTFCSKCPDGSWLNELMQCEKCGPGCSLCKSRGTCVECQSGYYWGEETGQYTQYTAYFNGAGRCLQCSIKNAKSCDANSVLSCVDGSYLQNSNCVDCLMQCQTCTNGNSCVTCKQGYYQQNNECQYCIGNSDMNINCLECSDLNTCTKCADSYMLINSQCYLIPVDPGCETFRAKGTNQVVCDVCLNGYYLYQGTCYSCLNENELYDLCTNLDESGQSPSVYPTQCLTNIADPISSSNYFLIQQTDQEIKTNLCVQNNNGCTKMIDSNGQCSQCADQYTLNNGVCYPCSTILNCLECSYNNEVVCNKCIQSTYLNNNECVQCIEGCNKCSSQNSCDTCSTGYYYNTQQQCVKCSVQNCSSCPNDTCQSCVPQFFLYAQTCQLCPPGCSNCQGTLGRECTTCLDGFYLKDNGCYPGTQYCAQHNSDGTCKHCIYGAYVADNQECLPCISLGAGYVCGQNANVYCFLGILQFAVLFMLLFQ

SEQ ID NO: 10 - protein, 305 aa, Trichomonas vaginalis
MLGIFICLASSALGKRMKLDDKDVIPNCPSISWEESETSFTEENINAGECRSISSYAYAVASESDFDVDLYHFNDLSKPFKTVTNPIFINNPGATHDADAGFLAAIRCHDKEKECKVQLILQYFPSWVSEIDGQNINNELYITSLKSGKIEKDVKVNNAGIGTSFLSRNTYKVVGEPKDKVKIIIIPDYETAANEVEVTGPATTVGGSEEQIKVTITYETTKEGDKLWFPEFAGWIPQRADAFRVEDLTNEASSNTPTPTASSNKLSGGAIAGIVIACVVVVGAIVGVLVWFFVCKGASAVAPEP

SEQ ID NO: 11 - protein, 310 aa, Trichomonas vaginalis
MFCFLSFFTASIRNKRMKLERSRFGNCTYLDQDYLDTVDLYGLTIKAGECYELMFYSYAAAGDSDFEVDLYKLTGTQTPYKTVKNPIYINNPYMVLLEEENEPDAAFWASVRCADKDKECKVQFIPQVYISYLAEEKDYNAEIYLTSAKSGKIEKSAKNSTIVEFFISKNTYKIVSEPKDKVNFYKFDRYAVQDTPIENNEIEFTGFATTYGRPKSEEEMVLTFTYETTKEGDKLLFPEVTGWIPQRADAFTIDDLKNEDSSKDEEPSKKKLSGGAIAGIVIACVVVGAVVGVLVWFFVCKGSSKVAPAP

SEQ ID NO: 12 - protein, 713 aa, Giardia intestinalis
MFGRFLLAIVILQLARTACTQEADDGKCKTCGVTIGQDTWCSECNGANYAPVNGQCVDVNAEGPSKTLCPQHSAGKCTQCGGNSFMYKDGCYSSGEGLPGRSLCLSSDGDGVCTEAAPGYFAPVGAANTEQSVIACGDTTGVTIAAGGNTYKGIADCAECSAPDATAGAEAGKVATCTKCGVSKYLKDNVCVDKAQCNSGSTNKFVAVDDSENGNKCVSCSDNLNGGVANCDTCSYDEQSKKIKCTKCTDNNYLKTTSEGTSCVQKDQCKDGFFPKDDSSAGNKCLPCNDSTDGIANCTTCALVSGRSGAALVTCSACTDGYKPSADKTTCEAVSNCKTPGCKACSNEGKENEVCTDCDGSTYLTPTSQCIDSCAKIGNYYGATEGAKKLCKECTAANCKTCDDQGQCQACNDGFYKNGDACSPCHESCKTCSAGTASDCTECPTGKALRYGDDGTKGTCGEGCTTGTGAGACKTCGLTIDGASYCSECATTTEYPQNGVCAPKASRATPTCNDSPIQNGVCGTCADNYFKMNGGCYETVKYPGKTVCISAPNGGTCQKAADGYKLDSGTLTVCSEGCKECASSTDCTTCLDGYVKSASACTKCDASCETCNGAATTCKACATGYYKTASGEGACTSCESDSNGVTGIKGCLNCAPPPNNKGSVLCYLIKDSGSTNKSGLSTGAIAGISVAVIVVVGGLIGFLCWWFLCRGKA

SEQ ID NO: 13 - protein, 141 aa, Nematostella vectensis
CTSCIPGLVLSEKGGVCESECSKGRYKSGDACKPCHVSCNACRGPAKGDCLRCNPGHVYFKHTCVTECPEGTFVDDSDGADARRCRPCHAACRTCTGLSVDECTSCSKHLFLQKTSCVLQCSAAYEPDSSSMLCKPCEKSC

SEQ ID NO: 14 - protein, 633 aa, Giardia intestinalis
MLLIVFYLVLSALAANCETEGNKSNCDSGRCEMVGIVEVCTQCKTNGHVPIDGVCTPKNEADANCKKDGGSPLDQDAKICGQCAQGYFLHKGGCYAIGGNVGRIICNDPTPTLKGRNSVEGVCSACNSTSGFFKNPANVANKDSCIACDDTTGDSGNVGLEGCATCQHSGSGAATCLTCKDGYYDNNPSQDTVTCASCTDDCKTCIDTGNAKCTSCQTKYLKITDPNGVFGECVDENTCKQPGTHFPITTTDNIKVCALCSDAENKGVVGCAKCTSTPASDSGNAIIVKCIECTTPDTTKPNFAGTGCFACSATDCSNCSADNVCEKCGKGKKLSPLKDSCLDSCPAGTHNKDNVCVPCHTSCAECASDSVGESSCTACYPGFALRKGEDEATGACIPECTGKYAENCEAGQCTAIVGGSKYCSKCKAGYVPVDGVCVSTTARTPTGCTPNDNNDGTCKECTTTYFLQSGGCYNAQTFPGKLLCTAATGNGQCQTCAASGQSPAGGKCPECSEGCAKCTDSNTCNECFSGYYKGAGNKCFKCTDGDKANSDAITGVENCVSCAPPISGNGGSVICYVKTDGTGGGDNDNNTGGSTNKSGLSTGAIAGIAVAAVIVVGGLVGFLCWWFICRGKA

SEQ ID NO: 15 - protein, 451 aa, Giardia intestinalis
MYRSAPRTITPQERCNLSLVITHPVPIEARGNRAISWPPVGVLLSRSSLVQLVKESESDCLSLLVATHQPDERAVAHELRLMLVGFLLVCATVLAKDSGKTACEQKTGVCDGSLTTAGCATCTPAGSSQTCLTCTTSSHKIRPDEKGCISECPADVSTDVDGFCKCKSGYTPSTNGQTCEQKTGVCDGSLTTAGCATCTPAGSSQTCLTCTTSSHKIRPDEKGCISECPADVSTDVDGFCKCKSGYTPSTNGQTCEQKTGVCDGSLTTAGCATCTPAGSSQTCLTCTTSSHKIRPDEKGCISECPADVSTDVDGFCKCKSGYTPSTNGQTCEQKTGVCDGSLTTAGCATCTPAGSSQTCLTCTTSSHKIRPDEKGCISECPADVSTDVDGFCKCKSGYTPSTNGQTCEPSNTNKSGGLSTGAIAGIAVAAIIVVGGLVGFLCWWFLCRGKA

SEQ ID NO: 16 - protein, 584 aa, Giardia intestinalis
MLLTAFCIMASVLAATCTVEASTRDCAESKCEMVGGTEVCTECKYAGNVPINGACKQKGDSAVTTAGCKKANGTGLAEDKVCERCDGAYFLYKGGCYGVDNEPGQKLCTKAAEGACTEAAPGYFVPPNVAGSDQSVIACNYTISVPVLDGRSYMGVAHCTLCDSPKIASDPTPKPAVCTACEDGYFLGAAGDKESKCILCGDTSGSTWKGVDGCLKCTASGKADTPATCTECQEGKYLKGGDPTSCILRNACTGTHFPNDNVENKKKCLPCGENANGGIENCAECSLLSSVSGSATVLIKCSKCGSDKKLSPLKDACLDSCPVGTYDKQSVCTPCHSSCASCTDTTSTTCTACYSGFVLNTTTGASAGTCIQECTGQYAENCADGQCTAIVGGSKYCSKCKAGYVPVDGVCVSTTTRAVTGCTPGDGVCTACTGSYFLQSGGCYQSTVYPGNTLCSSATNGKCTSCTNGQTADKNSGSCPACPDGCSKCTGSASPQQCSGCFPGYYKSGDKCVKCDASANGITGVPNCISCAPPSNGQGSVTCYVNGSGASRADANRSGLSPSAIAGVSVVVIIVVGGLAGFLC

SEQ ID NO: 17 - protein, 247 aa, Giardia intestinalis
MFEKIIFGIAILQLALAAQTTGKNPAVTCAEDKTRNRTYKTQCTQASPSNCQVDHCTRCAAGNPAVCDECEPGYTANPEKTQCTQASPSNCQVDHCTRCAAGNPAVCDECEPGYTANPEKTQCTQASPSNCQVDHCTRCAAGNPAVCDECEPGYTANPEKTQCTQASPSNCQVDHCTRCAAGNPAVCDECEPGYTANPEKTQCISSNTNKSSGLSTGAIAGIAVAAVIVVGGLVGFLCWWFLCRGKA

SEQ ID NO: 18 - protein, 539 aa, Giardia intestinalis
MSSCHQSCTTCDGQDDASCTSCNSTSFLAVQGNDRGYCISCSTEVPVHGYAGIRGCSRCMLPSSTDTAPVCLDCSEYDYMVSINGRSCVASCGIGASSNYYTRQCTCIAGYGLDQGNRAQGCILCKVSSCALCTDNADICNACEIPFGLSLDGRNCLEVGGCPANCVCENNGTDSGATCVLCEKRYFLQPARRICLHSCPIGYAANPITNTCDLCPANCYSCERAIEDQCTSCVDGYFIYRTDSNVLTMGRCVPECAEAAVGPCVECHAILGSARYCSRCSQGFFPLDGRCVSTSGQQISACAQTDKGLCLKCALGYFLHQGGCYSSLYAPGKLVCAAAERIDPAAYGTCRACTCGYHRTSDGGCIKCTMTGCFACPSSPDICTFCSNGYYSTQVSVDSEEVHCSQCAPGCLSCEDSSPSGCNLCAPGYFWTSSVHGCIRCDNSTISGPLKGIKGCKQCLVSSSETSVVCLDNDPDSPFAFPPLSTNRTTLILSITLPLAVLLLAATVITLAIILVKKRKTTKHGLSTNPVTLTTMVST

SEQ ID NO: 19 - protein, 807 aa, Giardia intestinalis
MRPFSLSLISTCLLTVFFSEEVPIYHNGFGYSCKDAVLNCLQDKCLINLTMFLCTECTSGHVPINGKCVSIKDQASTGSVCVKSPTGGWCTKCNGDYFLFYGGCYNLDSPWKKTICHRAENGLCKECGKGVEGYPSLVFTNPNATSLERCIHCGDPIGFGGHSGVYNCQQCSQPRLSGKVEADCETCSDSNMCPFDYRCKPASNIAAFGYCDYCPKAYVWSASACYAIGSITGNSICLSRNTIDVRGQSLCTQCANSSEVPQNGLCRSISGFDDICTKDPKTGKCTSCKNDSNGQYFLFYGGCYLFNNILDQVGSQICQTVQNNVCTACNSSTKEVFTRNSRCWHCGDSANGGIEGCQRCEMKDSGLQCLECRDLYLSLDKRSCLASCPKGQKGIQGSSSSTHSCACDDGSYLKDGKCVGCAVENCAECDESSCKKCKYGYTLSDSQCVATKCKDPNCDTCEDRDVCTKCTDDHSLDPHGLCVKDCLGSAGYYKATVGGVSRCVACTLGNCAVCESESKCKTCRDGFYVEGSGECKPCSSECATCSGPASGDCTACPAKRRLEYSDGTKGSCVPQCVQDSSCAECGLTVGGTSYCSRCVKSTEYPNNGACTSSSSRAAGIACANVAAGRCVACSSNSFSLNGGCYTSTLLPGKTVCTKASDGWCDSTVAGYGITYNGTLLTCPTNCAMCSSGVCSACNSGFYLEKEVCKACSKGCATCPHGEACFDCLAGYYFSESTCKACHKVISKCSLCVVPEGAVKPICLEYDNTSKKSALSSGAISGIAIGVVLVVGGVAAVLVWFFVFRKKN

SEQ ID NO: 20 - protein, 713 aa, Giardia intestinalis
MFGRFLLAIVILQLARTACTQEADDGKCKTCGVTIGQDTWCSECNGANYAPVNGQCVDVNAEGPSKTLCPQHSAGKCTQCGGNSFMYKDGCYSSGEGLPGHSLCLSSDGDGVCTEAAPGYFAPVGAANTEQSVIACGDTTGVTIAAGGNTYKGIADCAECSAPDATAGAEAGKVATCTKCGVSKYLKDNVCVDKAQCNSGSTNKFVAVDDSENGNKCVSCSDNLNGGVANCDTCSYDEQSKKIKCTKCTDNNYLKTTSEGTSCVQKDQCKDGFFPKDDSSAGNKCLPCNDSTDGIANCATCALVSGRSGAALVTCSACTDGYKPSADKTTCEAVSNCKTPGCKACSNEGKENEVCTDCDSSTYLTPTSQCIDSCAKIGNYYGATEGAKKLCKECTAANCKTCDDQGQCQACNDGFYKNGDACSPCHESCKTCSAGTASDCTECPTGKALRYGDDGTKGTCGEGCTTGTGAGACKTCGLTIDGASYCSECATTTEYPQNGVCAPKASRATPTCNDSPIQNGVCGTCADNYFKMNGGCYETVKYPGKTVCISAPNGGTCQKAADGYKLDSGTLTVCSEGCKECASSTDCTTCLDGYVKSASACTKCDASCETCNGAATTCKACATGYYKTASGEGACTSCESDSNGVTGIKGCLNCAPPPNNKGSVLCYLIKDSGSTNKSGLSTGAIAGISVAVIVVVGGLIGFLCWWFLCRGKA

SEQ ID NO: 21 - protein, 1035 aa, Giardia intestinalis
MLLGIVLLCAAVLAKECVPQISGCAECDESTGTKCTRCDPAGNTPFLMETTPDGGEGTCVGDCTQTPGYYGDASDDQNKKCKKCNAACAACSGAEATKCTRCDPAGNTPFLMETTPDGGEGTCVGDCTQTPGYYGDASDDQNKKCKKCNAACAACSGAEATKCTRCDPAGNTPFLMETTPDGGEGTCVGDCTQTPGYYGDASDDQNKKCKKCNAACAACSGAEATKCTRCDPAGNTPFLMETTPDGGEGTCVGDCTQTPGYYGDASDDQNKKCKKCNAACAACSGAEATKCTRCDPAGNTPFLMETTPDGGEGTCVGDCTQTPGYYGDASDDQNKKCKKCNAACAACSGAEATKCTRCDPAGNTPFLMETTPDGGEGTCVGDCTQTPGYYGDASDDQNKKCKKCNAACAACSGAEATKCTRCDPAGNTPFLMETTPDGGEGTCVGDCTQTPGYYGDASDDQNKKCKKCNAACAACSGAEATKCTRCDPAGNTPFLMETTPDGGEGTCVGDCTQTPGYYGDASDDQNKKCKKCNAACAACSGAEATKCTRCDPAGNTPFLMETTPDGGEGTCVGDCTQTPGYYGDASDDQNKKCKKCAEGQKPNTAGNKCFVCPDANCERCDQSDVCARCSTGAPLENGKCPAATPGCHSSCDGCTSDAMTNQADKCTGCKEGRYLKPNPAAGQSGTCLTAEECTSDKTHFTKEKVGDSKGMCLPCSDATHGIADCKKCALKTLSGETESTVVCSECTDKWLTPSGNACLEQCPAGTYPNDNNLCTPCHDTCAECNGNADAASCTACYPGYSLLYGSGTAGTCVKECTGAFGANCADGQCTADVGGAKYCAQCKDGYAPIDGICTAVKTGRDASVCTAAGGKCTKCAGEYTLMSGGCYGVAKLPGKSVCTLANNGKCTMCAANSQAPVQDKCPECSEGCAKCNDSNACTECLPGYYKNKSSACIPCSKDSTPITGVPNCVSCAPPAGGNGGPVLCYLMKGADNTGGSTNKSGLSTGAIAGISVAVIVVVGGLVGFLCWWFLCRGKA

SEQ ID NO: 22 - protein, 2539 aa, Giardia intestinalis
MISLSLRLGLIVAACVTPATRSPQSGDCLIGKCTVLDGQYCAECAIPGEVPINGVCIPLTDPRAVASGCGGSAEAPLSTSARRCEFCRGGSYFLHEGGCYNVLYSPGNRICRTATSGYCTLCVDGFFLDTTSSIHQCKPCHSTCATCTSGTAQSCLSCRSDRFLKTNECKECSAADGGVTACAQCSQNSDEITCTLCKEKYFVKEGKCTACAANCATCTGERPEDCSVCVSKYSYDLTAKSCTQTCDEHDSQATKCKTSMCTALNNRYCSQCASSSDLLIDGKCVSADDKKICTPFDPPNGTCSTCAKGHLLFQGGCYSVAEPLGQEVCAETSEVQERTVCVRCAQSGFVPVSGVCLRYDAQEVAAVGCVTSRGSAVTPTDTTCASCGAKAFLYKGGCYSNETSPGNVICDELDGTGGCKVCSNKYYRSGSTCAPCHQSCETCSSGAADSCLSCKKDVYFEVFSGGRGYCKPCNDPVATITIVGVANCERCSPKPSGTMPICTKCTTGHVLKGNSCVQVCHEGAEGAGQCKTGHCNTISNTYCSECATSTECPVDGICTATLDGHSAQDGACTSCASGYFLYNGGCYRKGVMPGMLICKDEDDSTSTCSKCEDGYMSSGNGCKVCEVSNCRACSGDAASCTSCNSGYFLKDNIKGSKVCEKVCEEGIGPGKCIYGGCTVRDNTFCSRCSEADEVPIDGVCSLPEKRARICLSASSGACLRCAATHLLYYGGCYKITQPVIEICKQDSQIVEKDTAYCKACSDAGEYPVDGSCTAELDGNTCTSSKCTACGSGYFMHRGICMRQESHSDICARVGAGVCEECGKSYFKNPVASTAIDSCIACSDTAGSNGYTGIDHCDTCLPPKAAGPATCTDCADRYILNEQNRCEESCPEVEESSKATGKCLKGYCNVLNGKYCSRCSLESDYLVDGRCTSTNSNVCTPHTQQNGMCASCAMTHILYMGGCYNPAAPPGSKACARHNLIGNTLYCFQCGVVTDLLVDGHCLAPGSTEAAVCTLHRIPTGTCYYCSSDYFLMLGSCVSAERAPGNTVCKDLGVHDGICSTCKDGYYAPPDRSSVSDSCVPCTENSDTLKGIPHCKSCKVSNGLLVCVACEQFYRPMNGGTECVQTCIEAEADPKEHRCRKDKCDVLGTFYCSQCAADAEGPVNGVCASVAAGVCIQYKQANGTCKYCTHGYIKYKGGCYEAGSFEAGDICDAQDVVTSGAGSFCAKCKQKDEVPVDGECKVSDDCTVKGDGICRSCKQGVKSFQITKDGSPATVACFTKCPDGMYESAEFCQLCDKSCKTCQDSAAKCTGCADGFYLAAGKCVACSVLHCLTCNAANTCASCQDGYYASGNSCVACTPGCKKCDSTGCKVCKDRFALRNNICIEECPVGLLSTSCAAGYCNVNGTLACSRCALLNSVIIDGKCKANDDACIRTTPSSGTCAACKDTHLLYYGGCYAKGAAAGTAICDSQHQATLGPYTICKQCKRDGEVPIDGSCVALANTRAIRSQCVAATPSPTSCTRCGPRFFLHAGGCYEIGRSPGTVLCAVAVDSAVAGVCTSCASGYYSTGLLDPTKESCILCNDTGATNGYTGIDGCTECYPSETPKRVICTRCKDKHIPSEDGSRCIQSCNDSRSESGNCKAGSCTAMGSLYCSRCALDDEWPINGACTGRDTDYVCEKGKGVCTGCLRGYMLYMGGCYDPAAIPGSGICRELLTVGGRTYCKQCNLAGAFPINGLCTKDVPDGVSCSSGLCVICPENYFFHEGGCYDITTTPGSGICEVLGTGRDAGTCRRCRPGYRHNKETLTCMSCAVSNCASCEIDVKYCTECIQPYTLTGVGAGAYCTKPCKRVGQDACSWGSCTIMDGSLCSQCASSDYVPIDGVCTLYPGDARSLAGPCVKDATKGRCTACRGSYFLYQGGCYSAGEYPGTGICDERDATVVDGQVVCGSCLIDGEVPLDGTCAEPKEGLICSKGVCSHCGDGMFLFEGACYTKGRAPGTSICGDTTESTSGCAACEAGFSKTNKGCVRCSDPNCGACVDDPNTCTACRAGYYLQSTSCIACHPACKTCDGMGADKCKECAEGYFGTFATPGLGACLACSDTSGKDSWVGVSGCRLCEAPKVAGPALCKDCLPGYKALSTGTEVTCHAVCPMTYYEAADSCIPCAIDNCATCTSTRCTSCVPEHIWNGEECVPKICPPQCLCREQSIACIGCNENAVEVRPTHSSASRCLLCNDAGAGGGWTGVDGCQRCRLADRVGPVVCLACESGRKALTLDGMLLCPRECPTESFWTSGRECIPCALGCLRCTSATTCSACSQGYYSTQSSVSAPSDCRPCDDVTSQNGFTGIPHCAVCAADRARAGVTCHACAEGYGLSGGSCSPCTAAGCARCDGGVCTSCKRGWHLAGDRCLACPSPCAACSSAASCLACADGYFQATLLGGPRDCVPCDQTAPQGLQMAGIHGCGLCQAQAGSGAVLCLRCANGNLPLENYCGGSSVKRRLGPGAITGITLGVAVLVGGAIGLALGLTVCKRGCAGSTGEGLRPLYA

SEQ ID NO: 23 - protein, 551 aa, Giardia intestinalis
MLLVAFYFVLSALAAECSAEGTAKDNCEANHCEMVGGTEICTQCQTGKVPIDGQCAGATDSNTKCKNADGVADADQTCGKCLLETFMYKGGCYVTTKAPGNVMCGDAAAGKCTQVKAGYFLPPGADNAHDSVVSCGDTTGVTLTDNKKYTGVAGCGKCEQPGEAQNGTPKAATCTECQADKYLKTESGTTSCVDEGNCNNGFFPTTDAQSNNKKVCALCSEADKGGIADCKKCSLKATSARAGPMVTCSECTNNNLSPLKDECMLGCPAGTYANNKVCTLCHESCAGCQTDDKETSCTACYPGSVLEHDGDLTTGKCIQECTGRYAENCEAGQCTAVVGGSKYCSRCKTGFVPINGMCVSTTARAATECVAGEGVCTSCTGAYFLESGGCYKTGAFPGNTLCIAAGANGKCANCANGQNADPQTGACPPCPANCSKCSGDSDVKTCTECYSGYYLDTGKECKKCSETSGNIQGVPNCVSCKAPSSPNAPTPVTCYVKTDATNNGDNDNNGGSTNKSGLSTGAIAGISVAVVVVVGGLVGFLCWWFICRGKA

SEQ ID NO: 24 - protein, 853 aa, Giardia intestinalis
MEPLKALDRYWTVLSQCTCGSFDSHWMIRTDCNGATRCTSMTYALRQSQFCSAQSTSFWPCAEIADCRVVSAIDPVSVDSISACGQRASEGSINCINRRGLTDVPRVCSYQSINRAMFGSFVLAGVLAQIAWAGKATERAAHCADNTNCAADACNVLIGGKLYCSRCNTGFVPINGQCADKEGATDKCKDGSGGDTADQTCGQCAEQTFMYKGGCYEAAQQPGQTMCQAADAGVCTQAAQGYFVPPGADASHQSVIPCGDEEEITVKNDKKYKGVLHCTRCNAPTEAADANAKAATCTACGDSKIVKTAKDSATSCVTEEECTGTEGFFVKNGGTKTCEACDPGCKTCKTEAAKCTSCKDDKPYLKKDNGSDTGTCVTEAECKTGNTHYPDDTEPKTCKTCAEGTSDGCATCEKGADGAVACKTCGSNKKVQPNKKGCIAKCPETVSAEKDGVCECVEGYVPDNAGTGCTKKPDPQCNTPGCKTCSEPKTSKEVCTECEDPKALTPTGQCIYGCEHLEGYYEGTSEGGKKACKKCEVENCLLCNGQGQCETCKDGYYKSGAACAKCNTSCKTCANGNSNGCTSCEPKQVLSYEGEGTGTCKPGCKPVSGGKDGTCKSCDLNIDGTSYCSACNVGTEYPENGVCVKKSARTASCQAEPSNGVCGTCARGFFRMNGGCYETTKLPGKSVCEEVASAGDTCQTPADGYKLNNGALITCSAGCKTCTSQDQCDTCKAGYAKDSGNTKKCVPCATGCSECNADDATKCTVCAAGYYLSKEKCIACDKSDGGSITGVANCASCTPPTNNKGSVLCYLIQNTNKSGLSAGAIAGISVAVIVVVAGLVGFLCWWFICRGKA

SEQ ID NO: 25 - protein, 239 aa, Giardia intestinalis
MLLVPLYFILGVLTATCTGRAQNNCANNKCEMLGATEICTQCNAGYVPIGGVCTAHNDQAVVAGTGAGCQKTGDTAVDGGSTVCEKCTEANYFLFMGGCYKTGEAPGNLICTAAASGKCSACVENGNVFKNKNSSPTLGTECILCSDDTGSNNNKGVANCATCTAPSADSGTATCKTCLPEFALDGSANACISNSGTGGNVNKSGLSTGAIAGIAVAVVIVVGGLVGFLCWWFLCRGKA

SEQ ID NO: 26 - protein, 201 aa, Giardia intestinalis
MCKTAEGGRCTAPSENGRYFLVPGASSTDQSVLACENPLGTVIGAGSTAKAYVGVYGCTACTAPAALEAPGMAPATCTACSGNNKPNLAGSGCFACTVDGCSHCGAGGKCEACTSKDQRPDTDGTKCIACNIDGCIRCSEENKCGQCGDDYKLEGGRCVSSGANRGGLSTGAIAGISVAVIVVVGGLVGFLCWWFICRGKA

SEQ ID NO: 27 - protein, 55 aa, Giardia intestinalis
MCLEMGDGTGDNTGGSVNRGGLSTGAIAGISVAVVAVVGGLVGFLCWWFLCRGKA

SEQ ID NO: 28 - protein, 833 aa, Giardia intestinalis
MIGFVSLLLCGIFSECTQDSECGGAGGTCDVTIGGKKYCSKCDGARVPVNGVCRLLNVSRSICQVPLNSAGTGSCTGCIRDFLFYRGGCYRTASLINAICKEKHIVEEGMYCGACAIEGDVPIDGVCVSASTDSSGNTCDKGVCTTCASGYFFHYGSCYKFGGSPGSTVCPKPTSTTGSVCDSCGSKFVKNPSASSSATSCLACYGLDGTLFCERCRMNVLTSADVKPTLCTQCKIGYVPVDGRCVSTYSATSALAGCSTYSGNENTKGLCETCSSGYMLFYGSCYSVNGPLAQAICKTENQIYLGGRVFCKRCAQTDHYPINGLCIADKGSHTCEAGICTACDTSMTSVDTSKVFLFYNGCYDANSAIGKLICQEASNGACSTCNTNETSNIIANPNSADGQPKCLGCWDEAATGVANCGGCAAGTDGDSKIVCSKCTDSTEPKDNTCPQALPPTTPEGCAVQGCQACSKDSATTCDACFEPLIMKEDKTKCFGSCLALGPGYYNNSGICSPCIENCLLCTDGATCSQCAEGYYLEVSGAGSTTGTCKACATGCSTCASAGDNLCSTCAVGYYAAFAPRRGETGKCILCNASGDGYTGVANCAVCYSTTGESGNKNVVCNTCDDGYIKQHTGNTVVCNLPTPECNAAMCSVCVENNPDRCEHCTTGAYLCPRTATCTKDCASCGGSMYPDDDLGECQPCDIANCRVCATGLKCESCAESAVPISPDVYHTACMGCSDTGGMDGWVGLAGCTTCELTDKGGGSVNCLDPGYYRRGGLGGGAIAAIVIVVLLVLAVAGFLVWWFVFRRGGRPKRGAKYTSLMRGESYDYRQSLI

SEQ ID NO: 29 - protein, 128 aa, Giardia intestinalis
MTAAICTSCDNSKKPNKGGSGCFTCAIDGCSHCNRDNMCEACNDGKKVSPGRKSCVDGCPSNSTDTDSVCVCSDGYSLDSSGASCVSSGANRGGLSTGAIAGISVAVVVVVGGLVGFLCWWFVCRGKA

SEQ ID NO: 30 - protein, 805 aa, Giardia intestinalis
MLKLLLLFFVGSFCGLPTGTYCNGFGIECGQGHEHCFSGRCLLIGSTKVCTRCVSGYVPINGVCQPYPGSASSVCIPEEAESSIRCIKCKPNENVFLFYGGCYTVDRSAVGGQICSRASNGRCVECNVSTHGAYVFTNPNETAEERCIACSDSIGFSGYGGVLECYSCTQPVTGGKTTALCTKCRSPEQNPIDHECRAKGLHTCFSGLCVSCYKTHLLYHSGCYSRGSDTGLAICAAKNQYVLDNVTICKECVNTLYAPKSGVCVPVDGDIPVMGFSDCTKDNDKGLCINCANSAEYFLFYGGCYYKKSGIGSRLCSAVVSGVCTEWKTQFDFIFNKNDNDGGYLCGDATNGGVSDCATCSYESGAVTCTSCSKGYLGVDGKSCSKSCSGDTRGVCTKVTEGSESIETSCRCVCMPTFYSSSGTCTPCTDSCAVCKDGTPDGCQICKPGKVLEPSVVTNGNAKCVDECTVGDNCAECGITIDGSRYCTRCKDSNMYPLNGVCIPNTQKDAYCTSKANGACTACSEAAFLMNGGCYTTEYYPGSTICDKQSNGKCTTTKKGYWISPDGKLLECDPTCLACTAPGPGRCTRCPSDKLLKRASGAATGSCVDPGACVDGYYADGDACLPCATPGCKTCGHASFCTECAGELFVSLDGQSCLEECTGDKVVGEVPGGVRRCWCERGFLPAPDKSGCVPAPECPPDMSWCASCDMSGRCLSCVTSGHNVQVDQRTCAEGCGARASSNQGVCMCETSTILDKGVCIPVNTLTGRKMVVVTASAASAVLVISALIGFLCWWFICRGKRRYYR

SEQ ID NO: 31 - protein, 741 aa, Giardia intestinalis
MFDKLIFVSLALQMALASQTASKAKTNPTPCAAANPGATNCAADSCNVEIGGQTFCSKCTGDKVPVNGECKAKTDAGMCTVGTNDKAGTCTACTNAHYLYKGGCYAECPDGTQKNEGRNTCDEVAPAGPTPCAAANPGATNCAADSCNVEIGGQTFCSKCTGDKVPVNGECKAKTDAGMCTVGTNDKAGTCTACTNAHYLYKGGCYAECPDGTQKNEGRNTCDEVAPAGPTPCAAANPGATNCAADSCNVEIGGQTFCSKCTGDKVPVNGECKAKTDAGMCTVGTNDKAGTCTACTNAHYLYKGGCYAECPDGTQKNEGRNTCDEVAPAGPTPCAAANPGATNCAADSCNVEIGGQTFCSKCTGDKVPVNGECKAKTDAGMCTVGTNDKAGTCTACTNAHYLYKGGCYAECPDGTQKNEGRNTCDEVAPAGCNLPNCEVCSEDKQKCTKCQSNYFLTPEKNACLGSCPAGTYLSGQTCAPCDPSCAECSGAGASKCTACPAGKMLRYADETKLNEGGQCVEQCVEGPECETCGLTIGGTKYCSKCKGSNVPLNGVCTSNAARTRFCTTAANGACTVCAAGYFIQEGGCYETTRQPGKQVCALTDNKGKCQTCTNSLGPDGAGTCPSCDPTCKTCSAANTANTCTTCATGYYKTALEGACTSCENSNGDITGVKDCLNCAPPPNNKGSVLCYLMKDGDSTGGSVNKSGLSTGAIAGISVAVIVVVGGLVGFLCWWFLCRGKA

SEQ ID NO: 32 - protein, 168 aa, Giardia intestinalis
MLYLVGLAFAYLALADPKSCTNSQNCASGDNCLDVNMNGSPTEVCTKCEPNNVPINGACQLCGEGHYLYSGGCYAACPQGTPNPETNTCDGVPTPDCNLPNCKSCPDGTCTECNDGFVPSNGSECVSSSVNKSELSTGAIAGIAVAVIVVVGGLVGFLCWWFLCRGKA

SEQ ID NO: 33 - protein, 331 aa, Giardia intestinalis
MYKSGCYKDSQAPGNTMCETATDGVCTLTKAGYFVPPGADASHQSVIPCGDEEEITVKDGKKYKGVPHCTRCNTPDAATDANAKAATCTACEDGYFVDSSKGCTACDGSCKTCEATRDTKRKSCTEETHFLGAASGGEGKCISCGDASDSTWKGVDGCLKCTTSGKNTPATCTECQEGKYLKGGDPTSCILRNACTGTHFPNDNAENKKKCLPCGDHVNGGIEHCLECALIEGQVEGVLVTCTKCSTRKKVSPGRKSCVDGCPSNSTDDNSVCVCNDGYSPDSSGASCVSSGSNRSGLSTGAIAGISVAVIVVVGGLIGFLCWWFICRGKA

SEQ ID NO: 34 - protein, 627 aa, Giardia intestinalis
MLLVAFYFVLSALAAACKQAQNCANERCEMVGETEICTECKDQGNVPVNGVCMPKDNDAVTTAGCKKNGGADLGAEDKVCGQCDGVHFLYKGGCYSTADATGQKLCTDAAEGVCSAAAVGYFIPPGAQKTDQSVILCGDVTEITLTNGKKYKGVQHCTVCTAPEAAESTAKPAVCTACDEGFFAASEGTCTACADNNNCAKCDAGADKCTKCKATAANKYFKDSGDGTGTCVNEQTCKEQSTHFPKDDPNNGNKCLSCSDDKSGGIADCKTCTPKENSEGPILITCSACATDTNKPNVAGTKCIACTVKDCKKCNDDGTCAECDNTRKLTPTKECVDKCEKLEGYFDGDDGTCRACNSVCKTCNGEDPYQCTGCPAKKVLKYTVESTPDSGSTCVDECTTNTNGCAECGATIGEAKYCSKCSDAKQAPLNGNCTASVRAAASCTQIENGICKKCATNYFLFEGGCYETTRQPGMQICKDAAGNDGKCKTCANNLPSNIDTGACPSCPAGCATCTAAGQTYTCQTCLAGYYLDSTKNLCIKCTESSGNIQGVTNCVSCNPPAGNSGPVTCYVKKDGTSDGGNDNSTGGSTNKSGLSTGAIAGISVAVIVVVGGLIGFLCWWFICRGKA

SEQ ID NO: 35 - protein, 646 aa, Giardia intestinalis
MLLGLLLFCTVARANCKAGNTPSANGQTCVPNADQCEDPLTTAGCATCTGTGSAQTCLTCSSSKKVRPDKKGCIASCPPSVTTENSGVCECTPGNKPSSDGTTCVPNADQCEDPLTTAGCATCTGTGSAQTCLTCSSSKKVRPDKKGCIASCPPSVTTENSGVCECTPGNKPSSDGTTCVPNADQCEDPLTTAGCATCTGTGSAQTCLTCSSSKKVRPDKKGCIASCPPSVTTENSGVCECTPGNKPSSDGTTCVPNADQCEDPLTTAGCATCTGTGSAQTCLTCSSSKKVRPDKKGCIASCPPSVTTENSGVCECTPGNKPSSDGTTCVSETACNTPNCKTCDNPKTDNEICTECNDGDYLTPTKQCTQSCGAIGSYYDGDKACEPCDPSCAGCTTKGPAKCTLCPPGKRLQYTNDDPNQGGSCVDECKAEVDGCAECGAVIGGTKYCSKCKEDKWAPQNGVCANSVTRNSFCTNAAGGVCTQCAADHFLQDGGCYKLGRQPGIQICTLADSNGGCQTCANSLQPNDGACPSCHSTCKTCSTADSSDKCTSCAAGYYMVGSGPNTCISCDSNSGSVKGVAGCMSCAPPPNNQGSVVCYLINDSGSTNKSSGLSTGAIAGISVAVVVVVGGLVGFLCWWFLCRGKA

SEQ ID NO: 36 - protein, 860 aa, Giardia intestinalis
MGVANCAQCQAPQSAGVVTCTECAAGSYKSPNTNECKVCDKACLTCSGEGATKCTLCASGKYLDGNNCVEASSCNGDKYPDPSTGKCTACNGAADQGGIPECTACTYDAKLQKPVCSACNGKKVKTELDGTTTCVDMSSGCQDDYHFKDGDTACLLCGDESKGVPNCATCTAAQQCTKCLPGFFKTSDTACDACGDNCATCSVAGDPNKCDTCMPGYFLVTTTDPQGKKCVACSDTTNGGHEGCSLCSNNNGFKCTDCKPNYKKQSNEDANDDYTCVKTCEDPTACGGTSGACDAMIIDDKGNAKHYCSYCGDSSQAPIDGICTSDSGKKGANTCDSHTCTQCTADYFLYMNGCYKVGQVPGSHMCKKADSSGICTEAASNKYFVVPEAQATDQSVLACGNPLGTLVDPQGTAKAYVGVEGCSQCKAPTAPSDGGMTPAVCTSCDNSKVPNKGGSGCVLCSDTNCKSCVVDNICEECKDGLYFKAGETPSCVSAEECKDGFFPTTDAQGKKVCAKCSDTANGGIADCAKCSLKAASARAGPIVTCSGCETKRLSPLNDACLEECPAGTYPDNRDSTGICASCHNTCASCSTNAETSCTACYPGYVLSRSSDDTGTCIKECTGDFMAHCKADGCSLNVGGSKYCDQCEEGYAPVDGVCTSIPATARDASGCKASGGKCTECGANYALLSGGCYNTQKLPGSSVCTAAQNKGQCQTCANGQSPAGGKCPACTEGCVKCAGSKETCTDCLAGYYKTTDNKCVKCTSNSGTDGNAITSVKGCLNCVPPIGSNTGSVLCYLMKDGNSTGRSTNKSSLSMRTIMEISVAMVAIGALVGFLCWWFIFRGRRIDASPSTMTLIPSKSI

SEQ ID NO: 37 - protein, 191 aa, Giardia intestinalis
MCAADRARAGVTCHACAEGYGLSGGSCSPCTAAGCARCDGGVCTSCKRGWHLAGDRCLACPSPCAACSSAASCLACADRYFQATPLGGPRDCVPCDQTAPQGLRMAGIHGCGLCQAQAGSGAVLCLRCADGNLPLENYCGGSSVKRRLGPGAITGITLGVTVLVGGTIGLTFSLMASKHKSQASGLRPLTA

SEQ ID NO: 38 - protein, 2529 aa, Giardia intestinalis
MLAIIFGLALSCTHGNRPGECAIGKCTILEGRYCSECATPGEVPINGLCIPYDDPRAVASGCASEAGKPLKNSAKTCSSCVEKNYFIHEGGCYNILYSPGNLICVDLARNLCKICSLGYYLDTQATPQTCKTCHAHCSSCSGSSENQCLSCPPDRFLDGSLCKRCSDKPYGIENCRSCTMSTSDSLKCLSCQAQYYLAGNQCLTCPSNCLMCTGATPNECLLCIDNYSYDSQTRTCILTCDKSKIAKSGKCAEDGCTAFENKLCAHCSLGTEVPINGVCTSNDQNICLHISISLGMCDNCGKGYILFQGGCYRVDTELGLKACAYTTDIRGATFCAKCGTPGFVPINGVCVPYNNPLVVTSGCRDSAGGLPTPVSIKCTSCGKNYFIYQGGCYSPESAPGNVICNEVDNAGKCKACVDNYFRNRGDCIPCHSNCASCLGPNANDCTSCAPEIFFQVFSMGKGMCKYCNDVLLQYDNAGIAHCAKCLPLPRGQRAQCTVCERGYLLTENHCEISCWTNGLAPGSCKSDHCNIFSSALCSCCANDNECPINGQCTSALMGAKVVSGRCTECPPRYFPYKGGCYEKGTPIGLSICKDVDDTATCSVCASGYTHVGSECRPCNIKYCVNCDGGVDVCNSCAYSYQLQKNEGKDSCVKACTEELTPGGCIYGGCVVRDKTFCERCSIEREVPIDGVCRPLREDAPECAVMEGGRCRRCSKGYLLYYGGCYNTIKPVIPICEKEHTLTGYGFTYCKKCTLETEYPINGSCTTETYGNTCKEGVCTGCGAGYFLHRTVCFTPEFYPQICTKARAGVCEVCGPTYYLNPVRSSTIQSCIHCSDVGGIFGYTGIAFCRTCLAPLISGPGHCTSCLDRYLLVNGVCEESCPLPTDSLQPRSGQCAVDFCNVLGATFCSKCALNTDALIDGKCTSVDKENICKKSGVPNGTCTGCAGLFFYYKNGCYNPKTYPGNAICGEYAVMDGVTYCFRCSILSDLPVNGHCIPMSDSKLSPCVLARVPTGRCYYCVDNHFLLKGSCVSADLAPGTILCKSIGSDNGICDICKEGYYAPPDRSSISDSCVPCTENSDTLKGIPHCKSCKVSNGLLVCVACEQFYRPMNGGTECVQTCVEAEADPKEHRCRKDKCDVLGTFYCSQCAADAEGPVNGVCASVAAGVCIQYKQANGTCKYCTHRYIKYKGGCYEAGSFEAGDICDAQDVVTSGAGSFCAKCKQKDEVPVDGECKVSDDCTVKGDGICRSCKQGVKSFQITKDGSPATVACFTKCPDGMYESAEFCQMCDKSCKTCQDSATKCTGCADGFYLAAGKCVACSVLHCLTCDAANTCASCQDGYYASGNSCVACTPGCKKCDSTGCKVCKDRFALRNNICTEECPVGLLPTSCAAGYCNVNGTLACSRCALLSSVIIDGKCKANDDACIRTTPSSGTCAACKDTHLLYYGGCYAKGATAGTAICDSQHQATLGPYTICKQCKRDGEVPIDGSCVALANTRAIRSQCVAATPSPTSCTRCGPRFFLHAGGCYEIGRSPGTVVCAVAVDSAVAGVCTSCASGYYSTDLLDPTKESCILCNDTGATNGYTGVDGCTECYPSETPKRVICTRCKDKHIPSEDGSRCIQSCNDSRSESGNCKAGSCTAMGSLYCSRCALDDEWPINGACTGHDTDYVCEKGKGVCTGCLRGYMLYMGGCYDPAAIPGSGICRELLTVGRRTYCKQCNLAGEFPINGLCTKDVPDGVSCSSGLCVICPENYFFHEGGCYDITTTPGSGICEVLGTGRDAGTCRRCRPGYRHNKETLTCMSCAVSNCASCEIDVKYCTECIQPYTLTGVGAGAYCTKPCKRVGQDACSWGSCTVMDGSLCSQCASSDYVPIDGVCTLYPGEARSLAGPCVKDAKKGRCTACRGSYFLHQGGCYSAGEYPGTGICDERDAVVVDGQVVCGRCLIDGEVPLDGTCAEPKEGLICSKGVCSHCGDGMFLFEGACYTKERAPGTSICGDTTESTSGCTACKAGFSKTDKGCVRCSDPNCGACVDDPNTCTACRAGYYLQSTSCIACHPACKTCDGMGADKCKECAEGYFGTFTTPGLGACLACSDTSGRDSWVGVSGCRLCEAPKVAGPALCKDCLPGYKALSTGTEVTCHAVCPMTYYEAADSCIPCAIDNCATCTSTRCTSCVPEHIWNGEECVPKICPPQCLCREQSIACIGCNENAVEVRPTHSSASRCLLCNDAGAGGGWTGVDGCQRCRLADRVGPVVCLACESGRKALTLDGMLLCPRDCPTEGFWTSGSECIPCAPGCLRCTSATTCSACSQGYYSTQSSVSAPSDCRPCDDVTSQNGFTGIPHCAVCAADRARAGVTCHACAEGYGLSGGSCSPCTAAGCARCDGGVCTSCKRGWHLAGDRCLACPSPCAACSSAASCLACADRYFQATPLGGPRDCVPCDQTAPQGLRMAGIHGCGLCQAQAGSGAVLCLRCADGNLPLENYCGGSSVKRRLGPGAITGITLGVTVLVGGTIGLTFSLMASKHKSQASGLRPLTA

SEQ ID NO: 39 - protein, 479 aa, Giardia intestinalis
MYKSAPRPIIPQERCDLSLSLTGLVLTEARENCTISWPLVGVLLSRSSPVQLIERARAAVSHCSRSMHQPSGRAVARVLRLMLLGFLLVCAVTQASCAAGCKTCDPGDQTCTACTNDSHKIQVDGKSCDAACPAHSAASSNVCECEGGYRPVTGENRCEKASNTQCNTPNCKTCDNPKTDNEICTECNDNNYLTPTKQCTQSCGAIGSYYDGDKACEPCDPSCAGCTTKGPAKCTACPPGKMLKYTNDDPSQGGSCVDECKAEMDGCAECGAVIGGTKYCSKCKEDKWAPQNGVCANSVTRNSFCTNAAGGVCTQCAADHFLQDGGCYKLGRQPGVQICAAVGPNSLCTTCVNGQRPDTNTGACPVCPTGCDTCTGTSSRAPECQSCLLGYYFDSDKKLCVKCTENSSAIQGVSSCVSCAPPSNNQGSVVCYLINDSGSTNKSSGLSTGAIAGIAVAAVIVVGGLVGFLCWWFLCRGKA

SEQ ID NO: 40 - protein, 817 aa, Giardia intestinalis
MLGLLSVLLFASFCEAAAEIYYNSFGVACKNNQNNCAQNRCIFVGRDELCTQCVSGYVPINGTCQLLDASSVCIPDDASSPTRCVECKSEQNVFLFYGGCYTIDQSTVGSDICCQATGGKCTECNVQTIKKYVFTNPDVGAAEKCILCSDTVGFNGYKGASGCLDCLPPITDKVGIALCFECNPRSLYPIDYQCQAKGLHNCINGYCTSCHKTHLFYEYGCYSRHSSTGFAICAGANQYELDNVTICTECVNTSHAPKNGGCTFVGESASGSLFSDCTKDASRGLCTGCSSTGKSFLFYGGCYDRNSFIGSRLCQKIDQGKCTQWSSTFDFIFPKTDTSSGDRYLCGDAGNNGVRGCATCGYNNGVTCTRCSAGYLGVDGKSCSESCSGDTRGACTEIVEKSSSTKILSCRCVCRPTFYNSSGTCTPCTNSCAVCKDGTPTGCQQCSPGKILNFSIASSESADCVSQCSVGSECAECGITIDGSRYCTRCKDASTYPFNGVCIPNTQRDAYCTSTTNGACTTCSGAAFLMNGGCYTTVHYPGSTICGKQSNGKCTTTKKGYWISDDGKLLECDPTCLGCTAPGPGRCTRCPSDKLLKRTSGATTGSCIDPNACGDGYYADGDACLPCATPGCKTCGHTSFCTECAGELFVSLDGRSCLGECSGDKVVGEVSGGVRRCWCERGFLPALDRSGCVLPTECPPDMPLCAACDESGKCLLCAASNHNIQIDQRTCAEGCGARASSNQGLCMCELDAVLTKGVCVPAKELARKRTAAIAGGTVAGVVVIGVLVGFLCWWFLCRSKHIGASSSTTALVRSKSV

SEQ ID NO: 41 - protein, 421 aa, Giardia intestinalis
MLYLAGLAFAYLALADPKSCTNSQNCASGNNCLDVNINGQQKEVCTKCEATHVPVEGACQAKDGQDKCTPQDAPDGTCKACQGSTYLYSGGCYTACPQGTPNSETNTCDGVPAPDCNLPNCEVCSDDKQTCTKCQGNYFLTPEKNACLASCPAGSYAVGQTCGPCDPSCAECSGAGASKCTACPAGKMLRYADESNPTDGTCVEQCVEGPECETCGLTIGGTKYCSKCKGSNVPLNGVCTSNAARTRFCTTAADGACTACAAGYFIQEGGCYQTTRLPGKSICTTDSGGKCQTCANGQNPNSGTGVCPLCDSTCKTCAAGQTQQCQTCFSGYYKSGTKCVKCDASDSQITGVTNCVSCAPPSGDSGSVTCYVKMDGTDNGGSVNKSGLSTGAIAGISVAVIVVVGGLVGFLCWWFLCRGKA

SEQ ID NO: 42 - protein, 638 aa, Giardia intestinalis
MRSRFRWSLCSTEFRDMKQGSVRLLMQTRAVLCQLLASMLVGIGLIFAVALADACSPSIDGCAECDSTGQGCTKCDANGNTPYLKKTNPGDQTGTCVSKEDCTRDGGYYADDTTDPNAKECKKCDATCAACSSGLATACTKCEAGGATPYLKKTNPGDQTGTCVSKEDCTRDGGYYADDTTDPNAKECKKCDAGQKPNTAGTQCFACPDSNCERCDQSDVCARCSTGAPPENGKCPAATPGCHSSCKDCVSGANTSEDDKCLSCSGDNYLKVTDTDAHSGVCVSASACTSDTTHFTKEVADSTGSKKMCLSCSDATHGITGCKKCALKTLSGETESTVVCSECTDKRLTPSGNACLEQCPAGTYADNINGVSVCASCHATCAECNGNADAASCTACYPGYSLLYGSGTAGTCVKECTGAFITNCADGQCTANVGGAKYCAQCKDGYAPIDGICTAVKTGRDASVCTAAGGKCTKCAGEYTLMSGGCYGVAKLPGKAVCTTANNGKCTMCAANNRAPVQEKCPECSEGCAKCNDSNACTECLPGYYKGAGDKCFKCTASSGNNNQITGVANCVSCAPPAGNAGGPVTCYIKTDGDNTGGSVNKSGLSTGAIAGISVAVIVVVGGLVGFLCWWFVCRGKA

SEQ ID NO: 43 - protein, 715 aa, Giardia intestinalis
MLIKRSPCLLSRTSHRLQTDQKVGAAHVRPLDRPHKRCLATQHTDIRCAGSLYWMLYGLLAMFEKILFGILILQVARAAKTCTEASSDPQTGQCKQGKCISIGGDRVCTDCAKPGEVPINGECKDKSDGLITTAGCEKVDGALDEHSTTCGKCTKAGYFLHKGGCYVQAAPPGQTVCKSASSSAGLCETCNDANGFFKNMGASDNTHQSCIACNEADTIDGFRGVPNCKVCTPPEGPGSATCTTCEGEYYLLAVTPSSCVEKTQCKTDHFPVTAKGIKKCVPCGDTDAGGIIDCKTCTLKEARGLAGESAIKCTTCNGGKTPNDEGSTCVDAPEPPPSDCPVENCQKCSADKKTCEECKDKNYLTPTGMCIKYCEYILGYYSSTEGGKGICKKCEVKNCVVCDPNGKCGFCEDGFYADDAGICQKCDGSCKNCKGNTANDCTECKPGTILDYANGQKGKCAPECVVNTDKATGNCKACDLIVKGTRYCSACSQDNEYPQNGVCAPKPSGRAATCTSQGTGVCNSCANGLLRMNGGCYEDEKYPAHSVCATVATTGGTCDRPMPGFNLNNENNLVICPEGCKTCNTANECTECMDGYIAFSNVKACTKCHESCYTCETAAATCKVCARGYYKESSDSGPCKKCSEGLAGCRQCTVSSTSAFMCLEMGDSTGDNNGGSTNKSGLSTGAIAGISVAVIVVVGGLVGFLCWWFVCRGKA

SEQ ID NO: 44 - protein, 72 aa, Giardia intestinalis
MKCSEKISGCKQCVSSSGSSVICLESEVGTGGSTNKSGLSTGAIAGISVAVIVVVGGLVGFLCWWFLCRGKA

SEQ ID NO: 45 - protein, 616 aa, Giardia intestinalis
MFEKILFANCILQLAWAACLEDDGNPGTHDTTKCKKGHCDVSIGEQPYCSKCSVDNEHLVDGTCVVSATDQANTKCIDPVEGKCGSCKDGYFMYKSGCYNSGGSPGNEMCTSAPEGKCSTPAAGYFIIPTTDADASHQSVVSCSDSEGANGKSDKIYKGVEGCAECTLDNLATTATCTKCTTDFLHAPIEGGTACLTECPEGYFGHTATSGKQLKTCQSCSSPEASLIPAATGVPNCVKCTYDTKVVCEKCDQDKYLKTESGTTSCVSAEECKDGFFPTADAQGKKVCAKCSDTVNGGIEDCAKCSLKATPASAGPLITCSECTTHNLSPLKDACLTACPAGMYANSKVCTPCHESCASCSNDAEASCTACYPGSVLNRSSGDTGACIKECTGRYAENCEADQCKAVVGGSKYCSRCKAGYVPVDGVCVSTTTRAPTGCTPGDGVCTACTGSYFLQSGGCYSAGAFPGNTLCTTASDGKCQTCANGQAADTTSGSCPACPDGCSKCATSGSPKACSECLPGYYKSGSSCVKCDASANGIVGVPNCISCAPPAGGSGSVTCYVKTDGTSGGDDNTGGSTNKSGLSTGAIAGISVAVIVVVGGLIGFLCWWFICRGKA

SEQ ID NO: 46 - protein, 632 aa, Giardia intestinalis
MFCRLIVAGFVLQLAWAAPEAETCTEAGEGQAGKCLTSKCDVWINGKKYCSQCAKTDEYLVDGGCKAEAGASGCQLKARAADGTCTQCAQGYFLHKNGCYAIGGDVGRFICADAAAASRVSSTTPGVCEGCVVGYFKNPSAANNKDSCIACNDATGVGGKKGLEGCATCDPPSSDVAICKTCLEGFFGTNLGNAGSTCTACTDRDNCAKCDGGAGKCTKCKATANKPYLKKGETEDSNTCIDKSGCNDNSHFTDDADDPTNGKMCKKCSEGIADCKTCALKDNPEGTILITCSACIAGTNQPNADGTKCVLCDIQDCIKCNEENMCEECTGGKSLNPLKNMCMEGCPAGTRDVSGICTNCHNSCAECDGDSEASCTACYPGLVLSKSNTGATGTCIPECTGRYAENCEAGQCTAVVGGSKYCSKCKAGYVPVDGVCVSTTTRAVTGCTPNDNNDGTCKACTTTYFLQSGGCYQSAAYPGSNLCSNAQNGKCTNCANGQQPEASTGSCPACASGCKTCEVANKEACKTCLPGYYLAGAKCVKCDTNDPNDGSHIVGVPNCISCAPPTGNSGPVTCYVKTDGTNDGGNDNNAGGSTNKSGLSTGAIAGISVAVIVVVGGLVGFLCWWFICRGKA

SEQ ID NO: 47 - protein, 140 aa, Giardia intestinalis
MAPAEILEETARTRAASPRAPSRGSPSLWSLSWGASWASSAGGSSAGGRRDLGSECCTVIVIVLCGVTCSVGDCKSCVMDDVCGECSDGFSIEGGRCVSSGTNRSGLSADAIAGISVAVVVVVGGLVGFLCWWFVCRGKA

SEQ ID NO: 48 - protein, 618 aa, Giardia intestinalis
MQHRQMPRRGGLVNRAVMACVTERRAIMFYAVLLIGLALQLATEECTPVSSGGPNTCKACDAVINGKKYCSQCNDTGNSDSSGAPTDGVCSADNNECSQKQDGKCTQCANKSFMYKGGCYKDSQAPGNTMCETATDGVCTQAKAGYFLPPDADRDNAHQSVIPCGDDTVVTLGNSKQYKGVPHCTQCEKPTEASDTTTAKAATCTACEDGFFGATCEACQDENCATCAMTGNNKCSKCKGTGTKTYLKVDGGSTGTCVEASGCTAATFPKVDEQQGNKCAACNSVPDGGIANCATCSLLTQGSRAAPLVTCLTCEQNKYLTPEKNACLDTCPAGMYAVSGDSGNVCTPCHESCASCSNDAATSCTACYPGHVLSRSSGDAGTCIKECTGDFMAHCKADGCSLNVGGSKYCDQCEEGYAPVDGVCTSIPATARDASGCKASGGKCTECGANYALLSGGCYNTQKLPGSSVCTAAQNKGQCQTCANGQSPAGGKCPACTEGCVKCAGSKETCTDCLAGYYKGAGDKCFKCTDSDKASSNAITGVENCISCAPPAGGNGPVTCYVTQQKADDGTGGDTGGDSTNKSGLSTGAIAGISVAVVAVVGGLVGFLCWWFLCRGKA

SEQ ID NO: 49 - protein, 190 aa, Giardia intestinalis
MLVLALIWSVALSYEVQCIEEEDGQCVRCPRGYIVNQRLNACVWNRASEPPIICPEGYFLDKGLCTLCHSSCETCTGSAEPNGCTVCAQGYYPAFTEASGLCIPCSTSHGVVAGIPGCVHCARDGDSLYCFERRQLKSNLATIRKTLVISLVVLVLALFSSLILIFAGGSKIKHRQRRLPVRYVARHKMV

SEQ ID NO: 50 - protein, 197 aa, Giardia intestinalis
MFDKLIFVSLALQMALASQTASKAKTNPTPCAAANPGATNCAADSCNVEIGGQTFCSKCTGDKVPVNGECKAKTDAGMCTAGTSDKAGTCTACTGAHSLYKGGCYDECPYGPTANERVCADAPAGCDLPNCKSCPDGTCTECNDGFVLGDDKKCVPSSVNKSGLSTGAIAGIAVAAVIVVGGLVGFLCWWFLCRGKA

SEQ ID NO: 51 - protein, 1609 aa, Giardia intestinalis
MHTWILTLLMCTCSNRHHYLHNSNHYLKGGALCRLAAKAGTAERILFSDVSDCPENCTSCTDPYICEVCDHGYTLTNRGRCVDLCIEGDSETNCAVGHCTVFDDTLCSKCAHEGDVPAAGVCNTGVTTCVKDSHGICISCESGHLLYRGGCYPSKSALAQSICATDNQIVVEGMLYCSLCNDENEAPINGHCTDEHSSYCDAESGQCINCVADGYFLFNGGCYNANEHPGSAICAEVRDGECTECGSHYPVTDGVCTYCPVDHCLLCENESCTQCQQGYVLRSSGRCVKLCSEGNGLQSCAIGHCTAFEGTLCTKCAYEEDVPVAGICTSGLTTCQKNFSQICISCEGEHLLYSGGCYATTGSYGLQICSIENQIAIGGKVYCSKCNQKKEAPLNGECTEAAADHCDVRDGACTGCKTTGYFLFQGGCYTLASIPGNIICAEVSGTTCIKCRDGYGIHEGECSPCTIAHCLDCKSDVATCNACDPKYFFTGTACVACEGEHCAACRDNMCVDCTDKTECNACAIPNCVLCDPALTECLACQEAYEPDEDGFCTPLPASECPLSCLCADQDVPALCTSCKPGFIAAGVVSGDTCLSCALEVEHCGLCSYIPESDSIVCEECLDGYRMDDGLCEPCGNGCKSCPHRANKCAECFAETPYFNPALTECLSACPPNSVAATNKKCSCIHGYYSTLQGCEKCDESCDTCSGGEIDKCVTCRSGFFLASGSWKGQCIPCDLSSFSDGSVIGVEHCIDCRGVQENGDLIVVCKECDLGYTLKGEVCVLDDSGHEDCPSNCICTDVSPTCVSCQRGYFTLSTPSAENCVRCSSAISGCKTCTVEGSSLRRSTSKVTCTLCDDGKGLVEGTCHSCHVTCKTCNGDPELCSTCYNPAYKLSLRSDQCVPECPEFSEEQNGRCVCLLGYSISFNGLTCVKDSSACPSICTCAVGNICSGCADGYFTFDPSRTDAARCEPCSGDFCSSCGRVPNDATFFGHTFSPGRRYAYRRSLESVNICIECADKQGCSACSIEGCNRCSASEHTKCTECMPDYQLSQDKKSCIALVPICPLGCTCVPGTSTCNGCADGYFEVDPTDEASGRCMRCSIPTRYIPTRISGARRLERLLSIRRKRTDSISLQIVRDASWNGVAGCAMCTTPSSPGPAICTQCVQGKHLLVSGESTQCLDACPDGMGSINNVCFNCNDENCLRCDENLDSCVECRPGASPTLTPDTELVVCETVCPLGCVCEDAEDSSICTGCQSGYYEVSVLARFIMRLRKTDVHCKKCLANCMTCTDESTCLVCADGYILHQTDASCVEKCDQGYYNKQGQCAPCTGEHCTSCTNETTCTSCTDSSFLSNGECVTCSTSCKTCGGGTENDCLTCPTGTVHSTGTGLGSCLQECSATAAGNCAVCNAIIDGTRYCSKCTPGEAPINGRCEPVSAARNVMCITSGDGTCESCSGGLFLFNGGCYATSRYPGSAVCTSSSDGLCTNCADGFTNTNGICSNCVLGCSSCSSTAASACTSCTEGFFPAFSGSQGVCKRCDDTTITDGYQGVQGCRICIAPQQAGIALCLDSSEAGNKSSLSAGAITGIAIAVIAVIGCAVGVLVWFLCCRRSKAV

SEQ ID NO: 52 - protein, 137 aa, Giardia intestinalis
MCVASGADPKGQACPTCPDGCLKCTGNVGSQTCSSCLSGYYLSTNKCFRCTAGDGASANAITGVENCISCAPPTGGNGGSVTCYVKNDDSSGSGTGGSTNKSGLSTGAIAGISVAVIVVVGGLVGFLCWWFICRGKA

SEQ ID NO: 53 - protein, 403 aa, Giardia intestinalis
MLVGFLLVCATVLAKHNEKTAPCEVEGCDVCEESNPQQCKTCGSGYTLNPTTKKCTKNPASDCGVQNCAQCVSGDNTRCETCSPGFDPNDDGTQCTPQADCPIVNCQTCSPDKQTCEECEPGKHLTPTKKACLDACPVGTYLSGQTCAPCDPSCAECSGAGASKCTACPAGKMLRYADESNPTDGTCVEQCVEGPECETCGLTIGGTKYCSKCKGNNVPLNGVCTSNAARTRFCTTAANGACTVCAAGYFIQEGGCYQTTRLPGKSICTTPTGDGKCQTCANGLTAVSNMCPLCDSTCATCTEANQPNKCSACPPGRYLDASKACKLCTETSNNIQGVANCASCAPPSNNQGPVLCYLMKDGGSTNKSGLSTGAIAGISVAVIVVVGGLVGFLCWWFICRGKA

SEQ ID NO: 54 - protein, 200 aa, Giardia intestinalis
MLSKLLFVSFILQLAQAVQVVEEAKAAVSAPTPCDAADPGATNCAAGKCDVTINGKTYCSKCKSGYVPVNGACTQQAQANMCTPGSGSTDGTCTACTQTQKLYKGGCYDNCPYGDGSAPNTCADAPAGCDLPNCKSCPDGTCTECNDGFVLGDDKKCVPSSANKSGLSTGAIAGIAVAAVIVVGGLVGFLCWWFLCRGKA

SEQ ID NO: 55 - protein, 245 aa, Giardia intestinalis
MLKYTDENSPSSGTCVDGCKPQSGASGCETCGATIGGTKYCSKCSTSTEVPVNGVCTADNARAAACKVKDGKGGCTTCASGYFRQDNGCYKTDRQPGIQICTLASQGDKCETCANSLQPSAAGVCPLCDSACKTCTSANDANTCSSCVVGYYQVGTKCVRCDTNDPNGNKPITGVKDCVSCAPPAGGDGGSVICYVKTDGTDNGGSVNKSGLSTGAIAGIAVAVIVIVGGLVGFLCWWFLCRGKA

SEQ ID NO: 56 - protein, 520 aa, Giardia intestinalis
MGVDNCLKCTAPANNKGVAKCTACTEGHFLHTDGTCQACGTGCSECTSNTVCTHCMPGRYLKTGGSCVDGSGSTCGEKKYPDPTTRECKACPEACRVCAYDDVLQQPVCSECDSGQAKNLLKKKVDGTAECVDENGCPTGETHFVDKTAGTKCLPCGDESKGVANCETCSAAQQCTKCLPGFFETNPTTCTDCTGHCAECGTAGQIDTCTKCLPGFFLKSSGGKECVLCGDSQKGGIDGCDVCEGTEDALKCTKCKVNYRPSGEPSTGVTCTKACEDDTACGGTAGACDAIVIDNDGKELHYCSFCGDSSQAPINGKCVASGSYDSNHCAKGVCTQCTNNYFLYMGGCYSVSAQPGNLMCKTAGNNGICTEAANNKYFIVPEAKPTQQSVLACGNPLGTLVGTGGTAKAYVGVDGCSQCKAPTQIDTLGMTPAICTACDSDRKPNRDGSGCVLCSVGDCKSCVVDGVCGECNSGFSLEGGKCVSSGTNRSGLSTGAIAGISVAVVAVVGGLVGFLCRGKA

SEQ ID NO: 57 - protein, 470 aa, Giardia intestinalis
MGKCHRREPGAGMQAPDPVLCPEAVSGPGNCKPGKCFGIGGEELSYCSQCADATEVPLNGACDNSEETQACTQMSDGVCTQCAKKTFMYKGGCYSTIGVPGVKMCKEATDGVCTSPAPGYFVLPADDRDASHQSVVSCGDGEGAPGRTKLYKGVKGCAECTLSVPATTATCNRCTTKNLSPLKDACLTDCPAGMYANNKVCTPCHESCASCSTNAEASCTACYPGSVLSRSSGGTGACMKECTGKYAENCEAGQCTAVVGGSKYCSRCKAGYVPVDGVCVSITTRAPTGCTPSDNNDGTCKACTTTYFLQSGGCYSAGAFPGNTLCSSAANGKCQTCANGQAADTTSGSCPACPDGCSKCTESASPQQCSECLPGYYKSGSSCVKCDASDNGIVGVPNCISCAPPAGGSGSVTCYVKTDGTSGGDNNTGGSTNRGGLSTGAIAGISIAVVVVVGGLVGFLCWWFVCRGKA

SEQ ID NO: 58 - protein, 39 aa, Giardia intestinalis
MNKSGLSTGAIAGISVAVIVVVGGLVGFLCWWFICRGKA

SEQ ID NO: 59 - protein, 185 aa, Giardia intestinalis
MCSVCVENNPDRCEHCTTGAYLCPRTAACTKDCASCGGSMYPDEDLGECQPCDIANCRVCATGLKCESCAESAVPISPDVYHTACMGCSDTGGMDGWVGLAGCTTCELTDKGGGSVNCLDPGYYRRGGLGGGAIAAIVIVVLLVLAVAGFLVWWFVFRRGGRPKRGAKYTSLMRGESYDYRQSLI

SEQ ID NO: 60 - protein, 792 aa, Giardia intestinalis
MLGLLPLALLASICKSSRDAYYNKFGVGCEGKQENCAQDRCFSIGSWTSCTQCIPGYVPIDGKCQNYSGASSPPCTPDDPNSPTRCIRCTSTENVFLFYGSCYTITTAQNRNLGNFLCSEASNGVCTKCFESKLERYVFTNPDTSAAEKCILCSDTVGFNGYKGASGCLDCLPPITDKIGIALCVKCHYTTEDRHFYPIDYQCQAKGPHNCVNGYCTSCYKTHLFYEYGCYSRHSSTGFAICAGANQYELDNVTICKECANASYAPRNGACILIKENPSIEEIAFKCTKDPTKGLCTACSSSAPSFLFYGGCYDEDARISSKLCSRIGSNACEQWNSAFKWIFSKNGDNNKNGYLCGDIANGGISGCATCNYASGAVTCTRCSAGCLGVDGKSCSEGCSGDTRGVCTKVTEGSESTEVSCRCVCRPTFYNSSGTCTPCTDSCAVCKDGTLTGCQQCSPGKILSFSIVSSESADCVDQCSVGSECAECGITIDGSRYCTRCKDASTYPFNGVCIPNTQRDAYCTSTANGACTACSEAAFLMNGGCYTTEHYPGSTICDKQSNGKCEKTKEGYGISADGKLLECDPTCLACTAPGPGRCTRCPFGKLLKKVSGAATGSCVGLNACVDGYYADGDACLPCATPGCKTCGHASFCTECAGELFVSLDGRSCLEECTGDKVVGEVSSGVQRCWCERGFLPALDRSGCVLPTECPPDMSWCAACDTSGKCLSCAASNHNIQTDQRTCAEGCGARASSNQGLCMCELDAVLRRASVFRPRSWPRRERRRSQEGRWPGSL

SEQ ID NO: 61 - protein, 317 aa, Giardia intestinalis
MEHCEKCSKDNVCEACGSEKKLSPLGDACLDACPAGTRTDANVCNLCHESCASCSTNAETSCTACYPGYVLKRDETNAKGTCIKECTGDFMAHCKADGCSLNVGGSKYCDQCEEGYAPVDGVCTSIPATARDASGCKASGGKCTECGANYALLSGGCYNTQKLPGSSVCTAAQNKGQCQTCANGQSPAGGKCPACTEGCVKCAGSKETCTDCLAGYYKGAGDKCFKCTDSDKASSNAITGVENCISCAPPAGGNGPVTCYVTQQKADDGTGGDTGGDSTNRSGLSTGAIAGISVAVIVVVGGLVGFLCWWFICRGKA

SEQ ID NO: 62 - protein, 470 aa, Giardia intestinalis
MIFVWIVLAGALASCREGILDGDCFLLSCDVILDQVYCSVCTAMTEFLIDGQCLSTNVDNTCRHSFGNGTCDSCAGPYLSYRGGCYRVGEDPGNFICKSEDVFYVDGTALCRKCVVYGEFPIDGSCTKKAQGNRCGTTGYEGVCETCGTGYFYHNGGCYRKNRFPGNKICADSSAVEHIGHCGACLAGYETYKGTCLACEDINCRKCGVSMSNCEVCHDGYYLDRDMHDGKGACVPCNPIRNCETCLTDEECTSCARGFFAGFLKASGHCVSCDKGGDGYAGVPNCQVCLPPHPGTSDMAAFCTECAGGFYLLISEDRTQTSCVVSCPKNKIHYSNRCVTELEGCHSYGRNDECVKCVSGYRLAEGVCERCAVDNCEVCTSSSSVCNICKAGYGLESGMCNLCGEGCRTCDGDVSVCTTCLLRFNYISPGKNCCISTCPEHSHEVFSGELGFCECYGDYKPSADGLRCEK

SEQ ID NO: 63 - protein, 732 aa, Giardia intestinalis
MSAHQTTPPLPGKAGAAQQVGGPMFGRFLLAIVILQLARTACTQEADDGKCKTCGVTIGQEQYCSECNGANYAPVNGACEDVETQADKKALCKAHASGACTTCGGNSFMYKDGCYSSGEGLPGHSLCLSSDGDGVCTEAAPGYFLNPLRANTKDSVVSCSDTTGFTDSGKTYRGVQYCERCDGAALTDAAGGDAKCTRCGQDKYLKDNTCVDKAQCDSGSTNKFVAVDDSENGNKCVSCSDNLNGGVANCDTCSYDEQSKKIKCTKCTDNNYLKTTSEGTSCVQKDQCKDGFFPKDDSSAGNKCLPCNDSTDGIANCATCALVSGRSGAALVTCSACTDGYKPSADKTTCEAVSNCKTPGCKACSNEGKENEVCTDCDSSTYLTPTSQCIDSCAKIGNYYGATEGAKKICKECTAANCKTCDGQGQCQACSDGFYKNGDACSPCHESCKTCSAGTASDCTECPTGKALRYGDDGTKGTCGAGCATGTGAGACKTCGLTIDGASYCSECATATEYPQNGVCSSTTVRAAATCKAGSVAKGMCNSCTNGFLRMNGGCYETTKFPGKNVCEEAAPAGDTCQTPADGYKLNNGALITCSAGCKTCTSQDQCDTCKAGYAKTGGNTKKCVPCATGCSECNADDATKCTVCAAGYYLSKEKCIACDKSDGGSITGVANCANCAPPTNNKGPVLCYLIQNTNRSGLSTGAIAGISVAVVAVVGGLVGFLCWWFLCRGKA

SEQ ID NO: 64 - protein, 727 aa, Giardia intestinalis
MSAHQTTPPLPGKAGATQQVGGPMFGRFLLAIVILQLARAACQADGSGSDGSCKTCGVTIGQEQYCSECNGANYAPVNGQCADVNAEGQSKTLCPAKGQGKCTQCGGASFMYKDGCYSKDTAPGQSMCTQASEGKCTEAAPGYFLNPLRANTKDSVVSCSDTTGFTDSGKTYRGVQHCERCDGAALTDAAGGDAKCTRCGQDKYLATTGTCGEGCTPDTEFSKEDSDNGKRCFACGDVTTGVASCEKCTPPSPDQAKPACTKCGGNNYLKTAADGTTTCVEQSACSPDSFPVENSQSGNRCVLCGDAANGGVDKCAACTPTDQGRIAPTITCIACTNGYKPSADKTTCEAVSNCKTPGCKACSNEGKENEVCTDCDSSTYLTPTSQCIDSCAKIGNYYGATEGAKKICKECTAANCKTCDGQGQCQACSDGFYKNGDACSPCHESCKTCSAGTASDCTECPTGKALRYGDDGTKGTCGEGCTTGQGSGACKTCGLTIDGASYCSECATTTEYPQNGVCAPKASRATPTCNDSPIQNGVCGTCADNYFKMNGGCYETVKYPGKTVCISAPNGGTCQKAADGYKLDSGTLTVCSEGCKECTSSTDCTTCLDGYVKSASACTKCDSSCETCNGAATTCKACATGYYKTASGEGACTSCESDSNGVTGIKGCLNCAPPSSSTGSVLCYLIQNTNKSGLSAGAIAGISVAVIVVVAGLVGFLCWWFICRGKA

SEQ ID NO: 65 - protein, 127 aa, Giardia intestinalis
MLVGFLLVFVVTQANCAPELTRAGCKTCSPDGQTCTACTNDSHNVQVDGKSCDANCPEHSAANGQKVCECEGGYGPVTGENRCEPSNTNKSSGLSTGAIAGIAVAAVIVVGGLVGFLCWWFLCRGKA

SEQ ID NO: 66 - protein, 2516 aa, Giardia intestinalis
MILFLELIGAALSICIQAAGSDRDTAICAENNCKVLDGQYCAECAIPGEVPINGVCIPLTDPRAVASGCGGSVGAPLSTSARKCELCRDGSYFLHEGGCYNVLYSPGNRICRTATSGYCTLCVDGFFLDTTSSIHQCKPCHSTCATCTSNTAQSCLSCRSDRFLKNNECKECSAADGGVTACAQCSQNSDEITCTLCKEKYFIKEGKCTACADNCATCTGERPEDCSVCVSKYSYDLTAKRCTQTCDEHDSQATKCKTSMCTALNNRYCSQCASSSDLLIDGKCVSADDKKICTPFDPPNGTCSVCAKGHLLFQGGCYSVAEPLGQEVCAETSEVQERTVCVRCAQPGFVPVSGVCLRYDAQEVAAVGCVTSRGSAVTPTDTTCASCGAKAFLYKGGCYSNETSPGNVICDELDGTGGCKVCRNKYYRSGSTCAPCHQSCETCSSGAADSCLSCKKDVYFEVFSGGRGYCKPCNDPVATITIVGVANCERCSPKPSGTMPICTKCTTGHVLKGNSCVQVCHEGAEGAEQCKTGHCNTISNTYCSRCATSAECPVDGICTATLDGHSAQDGACTSCASGYFLYNGGCYRKGVMPGMLICKDEDDSTSTCSKCEDGYMSSGNGCKVCEVSNCRACSGDAASCTSCNSGYFLKDNTKGSKVCEKVCEEGIGPGKCIYGGCTVRDNTFCSRCSEANEVPIDGVCSLGGERARICLNASSGTCLRCAATHLLYYGGCYKITQPVIEICKQDSQIVEKGTAYCKACNDAGEYPVDGSCTAELDGNTCTSSKCTACGSGYFMHRGICMRQESHSDICARVGAGVCEECGKSYFKNPVASTAIDSCIACNDTVGSNGYTGIDHCDTCLPPKAAGPATCTDCADRYILNEQNRCEESCPEVEESSKATGKCLKGYCNVLNGKYCSRCSLESDYLVDGRCTSTNSNVCTPQTQQNDTCASCATTHILYMGGCYNPAAPPGSKACVRHNLIGNTLYCFQCGVVTDLLVDGHCLTPGSTEAAVCTLHRVPTGTCYYCSSDYFLMLGSCVSAERAPGNTVCKDLGVHDGICSTCKDGYYPPPDRSSVSDSCVPCTENSDTLKGIPHCKSCEVSNGLLVCVACEQFYRPMNGGTECVQTCVEAEADPKEHRCRKDKCDVLGTFYCSQCAADAEGPVNGVCASVAAGVCIQYEQANGTCKYCAHGYIKYKGGCYEAGSFEARDICDAQDVVTSGAGSFCAKCKQKDEVPVDGECKVSDDCTVKEDGICKSCKQGVKSFQITKDGSPATVACFTKCPDGMYESAEFCQLCDKSCKTCQDSAAKCTGCADGFYLAAEKCVACSVLHCLTCNAANTCASCQDGYYASGNSCVACTPGCKKCDSTGCKVCKDRFALRNNICIEECPVGLLSTSCAAGYCNVNGTLACSRCALLSSVIIDGKCKANDDACIRTTPSSGTCAACKDTHLLYYGGCYAKGAAAGTAICDSQHQATLGPYTICKQCKQDGEVPIDGSCVALTDTRAIRSQCVAATPSPTSCTRCGPRFFLHAGGCYEIGRSPGTVLCAVAVDSAVAGVCTSCASGYYSTGLLDPTKESCILCNDTGGTNGYTGVDGCTECYPSEAPKRVICTRCKDKHIPSEDGSRCIQSCNDSGSESGNCKAGSCTAMGSLYCSRCALDDEWPINGACTGHDTDYVCEKGKGVCTGCLRGYMLYMGGCYDPAATPGSGICRELLTVGGRTYCKQCNLAGEFPINGLCTKDVPDGVSCSSGLCVICPENYFFHEGGCYDITTTPGSGICEVLGTGREAGTCRRCRPGYRHNKETLTCMSCAVSNCASCEIDVKYCTECIQPYTLTGVGAGAYCTKPCKRVGQDACSWGSCTVMDGSLCSQCASSDYVPIDGICTLYPGEARSLAGPCVKDAKKGRCTACRGSYFLYQGGCYSAGEYPGTGICDERDAAVVDGQVVCGRCLIDGEVPLDGTCAEPKEGLICSKGVCSHCGDGMFLFEGACYTKGRAPGTSICGDTTESTSGCNACEAGFSKTDKGCVRCSDPNCGACVDDPNTCTACRAGYYLQSTSCIACHPACKTCDGMGADRCKECAEGYFGTFATPGLGTCLACSDTSGRDSWVGVSGCRLCEAPKVAGPALCKDCLPGYKALSTGTEVTCHAVCPVAYYEAAGSCIPCAIDNCATCTSTRCTSCVPEHIWNGEECVPKICPPQCLCREQSIACTGCNENAVEVRPTHSSASRCRLADRVGPVVCLACESGRKALTLDGMLLCPRDCPAEGFWTSGRECIPCVPGCLRCTSATTCSACSQGYYSTQSSVSAPSDCRPCDDATSQNGFTGIPHCAVCAADLTRAGVTCHACAEGYGLSGGSCSPCTAAGCARCDGGVCTSCKRGWHLAGDRCLACPPPCAACSSAASCLACADGYFQATLLGGPRDCVPCDQTAPQGLQMAGIHGCGLCQAQAWSGAVLCLRCADGDLPLENYCGGSSVKRSLGPGAITGITLGVAVLVGGAIGLALGLTVCKRGCAGNGSLQPLTI

SEQ ID NO: 67 - protein, 255 aa, Giardia intestinalis
MLLIAFYLVLSTLAVRHTTNHHSEYLRSGSRSNRDTGNRDNAYAAGNCKDGMEEQVGADTVCKQCNAGFVPINGVCTAQGTPSIATAGCKLANNDPPGQDSTVCEQCGTDATYFLYKGGCYDASTGVGQSLCKRASNGACTEAGEGYFAAPNAKATEQSVIPCSDTTGVTLTGDKQYVGVENCATCDAPAGDETVAKCKTCSDRFSLRDNQCVPSSVNKSGLSTGAIAGIAVAAVIVVGGLVGFLCWWFLCRGKA

SEQ ID NO: 68 - protein, 593 aa, Giardia intestinalis
MFYAVLLIGLMLEMAWAAQAGDECEEVTGSEPNTCKTCSAVINGKKYCSQCNDTGNSNSGGAPTDGVCSADNNECSQKQDGKCTQCANKSFMYKGGCYKDSQAPGNTMCETATDGVCTQAKAGYFLPPDADRDNAHQSVIPCGDVEEVLVGNSHKYKGVLHCKVCDAPKAAASDTNPVPATCTTCEDGFFGPTCEACQDENCATCAVTGNNKCSKCKGTGTKTYLKVDSGSTGTCVEASGCTAATFPKVDEQQGNKCAACNSVPDGGIANCATCSLLTQGSRAAPLVTCLTCEQNKYLTPEKNACLDTCPAGMYAVSGDSGNVCTPCHESCASCSTNAKTSCTACYPGYVLSKGDDGATGTCIPECTGRYAENCADGQCTAVVGGSKYCSKCKAGYAPVDGVCVSTTTRAALGCTPGDGVCTACTGSYFLQSGGCYQSTAYPGNTLCSSAQNGQCQTCAANGQSPAGGKCPECSEGCAKCGASNSDVCTECYSGYYRTGTGKCFKCAADSDNGIVGVPNCVSCAPPSNGQGSVICYITRQETDDGTGGDTGGDSMNKSGLSTGAIAGISVAVVVVVGGLVGFLCWWFICRGKA

SEQ ID NO: 69 - protein, 724 aa, Giardia intestinalis
MAYIRMLLLTFYFIVNSFAAPCQQKGYHMVTCKPNSCERVGVIEICVQCRAGGVPINGQCSLFDTSYVAEARCTKSDGTALTSSDTTCGKCGGEYFLFMGGCYGIKYRPGNEICTRADDGKCTTCNTGNSGKYVFKNGDPNAAPGTECILCHDTMGANGYTGVANCAECSHAGTSSGAATCGKCQTEYFKSGDTCTPCGADCWICESTAKCTVCKYGKYIKENGNDRTCVDTSGCGTGNYADIRTNECKPCTDTSVNECATCTYSDTLRKPVCTGCNSGGAKPLLKVDLDGSATCVAEGECASGNTHFLEQSPKACVPCGDAKNGGILGCSTCSSKTTCTKCLDGYYNSGNGGTVTCTACGANCATCSAAGNDQCTKCKPGFFMKQPGSAGKCFACDSKADNGIEGCSQCNSGLTPTCTDCKSNYRKEGTNPVKCTKACEDPTACGGTSGACGAVVVDSAGAFSQYCSLCGDPATFPIDGVCTGDKGGNTCANGVCTRCAAGFFLFMGGCYDVSKAPGSHMCKSAEGGRCTVPGESGRYFIVPGASSTDQSVLTCSNPVGTLTGTGSTAKAYVGVYGCSACTTPVAPSDGGMTAAVCTACNNNNKPNLAGSECLTCTVSGCSHCNRDDMCSACTEGGKRPNIDGSQCIPCNIDGCVRCSEENKCGQCGGDYKLEGEACIFTKPSGGNRSGLNKEAIAGIAVAVIIVVGGLVGFLCWWFIYRGRK

SEQ ID NO: 70 - protein, 587 aa, Giardia intestinalis
MFYAVLLIGLMLEMARAAQAGDECEEVTGSDPNTCKTCSAVINGKKYCSQCNDSGSQSAPTDGKCTADNNECSTKNNGVCTQCAHESFMYKGGCYKKATEPGNTMCETANAGVCTQAKAGYFVPPGADRDNAHQSVIPCGDVEEVLVGNSHKYKGVLHCKVCDAPKAAASDTNPVPATCTTCEDGFFGPTCEACQDENCATCAVTGNNKCSKCKGTGTKTYLKVDGGSTGTCVEASGCTAATFPKVDEQQGNKCAACNSAPDGGIANCATCSLLTQGSRATPLVTCLTCEQNKYLTPEKNACLDACPAGMYANSKVCTPCHESCASCSTNAKTSCTACYPGYVLSKGDDGATGTCIPECTGRYAENCADGQCTAVVGGSKYCSKCKAGYAPVDGICVSTATREVMGCTPGNDGTCTACTGSYFLQSGGCYQSTAYPGNTLCSSAQNGQCQTCAANGQSPAGGKCPECSEGCAKCGASNSDVCTECYSGYYRTGTGKCFKCAADSDNGIVGVPNCVSCAPPTNGQGSVICYITRQETDDGTGGDTGGDSMNKSGLSTGTIAGISVAVIVVVGGLVGFLCWWFVCRGKA

SEQ ID NO: 71 - protein, 515 aa, Giardia intestinalis
MAPNTPTAATCDTCKAGYYKDNGACKKCVTGCIDCTGAGQCTTCEDGKYLKNNQCVDAGQCEATQYADKKTWTCKACDPDITDCTACEYSDATGKPQCTNCNGKLIRTAADGTTTCVDAAGCATVGQDGTHFRSDGDTKCILCGDSSGSGNDQGIADCETCSKEASQKPVCKACFPGFYLSSTCKPCAGNCAKCGSTGNIQDCTECMPGYFLKDAQGTKECVLCSDTTKGGIDGCSVCSNDGNTFKCTECKPNYRPSGEPGDLTCTKTCEDDTACGGTSGACDAIVIDDKGTTKHYCSYCGDSGKVPIDGLCASDKANNNGCANGVCTSCTAANYFLYMGGCYDVSKAPGSHMCKTANNGVCTAVSENNKYFVVPEATNAQQSVLACGNPLGTLVDTKAYVGVDGCSQCTAPAALTGAGMAAAVCTSCDSGKKPNKDGSGCVLCSVSDCKSCVMDNICGECVDGYSLDNGKCVSSGANRSGLSTGAIAGISVAVVVVVGGLIGFLCWWFVCRGKA

SEQ ID NO: 72 - protein, 258 aa, Giardia intestinalis
MLVGFLLVCAVTQASCAAGCQTCNPADQTCTACTDSSHNIQVDGKSCAADCPPNSAPNQKVCECEGGYGPVAGQNRCEQNPSAGCAAGCQTCNPADQTCTACTDSSHNIQVDGKSCAADCPPNSAPNQKVCECEGGYGPVAGQNRCEQNPSAGCAAGCQTCNPADQTCTACTDSSHNIQVDGKSCAADCPPNSAPNQKVCECEGGYGPVAGQNRCISSSVNKSGLSTGAIAGIAVAAVIVVGGLVGFLCWWFLCRGKA

SEQ ID NO: 73 - protein, 425 aa, Giardia intestinalis
MLYLAGLAFAYLALADPKSCTNSQNCASGDNCLDVNMNGSPTEVCTKCEPNNVPIDGACKPAADNTNSCVTSDSGAGGVCASCQGSTYLYKGGCYAACPQGTPNSETNTCDGVPAPDCNLANCEVCSEDKQKCTKCQSNYFLTPEKNACLASCPAGSYAVGQTCAPCDPSCAECSGAGASKCTACPAGKMLRYADESKLNEGGQCVEQCVEGPECETCGLTIGGTKYCSKCKGNNVPLNGVCTSNAARTRFCTTVANGACTVCAAGYFIQEGGCYKTDRLPGKSICTTPTGDGKCQTCANGLTAVSNMCPLCDSTCATCTVANQPDKCSTCPPGRYLDASKACKLCTETSGSIQGVANCASCAPPTGNSGSVICYVKTDGTDNGGSTNKSGLSTGAIAGISVTAVVVVAGLVSFLCWWFLCRGKA

SEQ ID NO: 74 - protein, 524 aa, Giardia intestinalis
MCKQAAGGKCTQAADAKNYFIPPANTDDTHDSVVWCGDEIGVTLSSTQYKGVAKCLVCDAPGGAGAATCTTCEDGYFGATCEKCHESCRTCEAAEENKCKSCTDGYFLGATNGAAGKCLKCNSKTEEGWHGVDNCAKCTSSNTQNTPATCTECVANFYLKPAADATPSSCVTETGCGDGYFPTIVDEVKKCIACSAATNGGIDDCKKCSLKTTSAKAGVEIVCTECNTKWLSPLRDACLDSCPPGTHADSGNICPLCHSTCAECDGNAGANFCTVCYPGFVLKRGETGNMGMCVPECTGEYAENCEADQCTAVIGSSKYCSRCKVGFAPVDGVCVSTASRAVTGCTAGNDGTCTACTGTYFLQSGGCYQSTTYPGNTLCSIAASGKCTTCANGQTADSNLGSCPACPAGCSKCATSGSPKACSECFPGYYKSGDSCARCDTNNSQITGVANCVSCAPPSNGQGSVICYITRQETDDGTGDNTGGSTNKSGLSTGAIAGISVAVIVVVGGLVGFLCWWFICRGKA

SEQ ID NO: 75 - protein, 682 aa, Giardia intestinalis
MLLAIFYFVISTLTAKCTTQTQTCEAEKCEMVGETEICTRCQTGKVPIDGKCVDATANANCKNASGDGDANQVCGKCIGANFFMYKGGCYDKEKVPGNTLCTTVSPDGVCSVAANEYFVPPNADATHDSVVSCSEETPIHLANNKQYIGVAGCATCSAPKAPGEDNTPKAATCTKCAAGFLHTPSEGLSSCEETCPEGYFGHTATAESKKTCKSCTGGSSEAPNVKGIGDCLKCMYNEASGNTLTCEKCSAQKKPSLDKTSCNDCTGQNCAFCSSSGGDCEGCDSGFILDGQNCVKSDCKTENCKACTNPKAANEVCTECISTHHLTPTSQCVQYCQALGNYYAGTNADNKKACKECTVANCKTCNDQGQCQTCNDGFYKNGDACSPCHESCKTCSAGTASDCTECPTGKALKYGNDGTKGTCGEGCTTGQGSGACKTCGLTIDGASYCSECDTQNEYPQNGICTSTTARTVATCKNSNVANGICSSCTNGFLRMNGGCYETTKFPGKSVCEGANADADTCKAPVPGYKVEAGKLVMCSKGCDTCSDATTCTKCGDGYTKIENSQTCTKCDSSCETCTGAATTCKVCATGYYKTALGESTCTSCENDSNGVIGVKGCLNCAPPSSSTGSVLCYLMKGENTGGSVNKSGLSTGAIAGISVAAVVVVAGLVGFLCWWFICRGKA

SEQ ID NO: 76 - protein, 762 aa, Giardia intestinalis
MHLYVDSTLNFLGHTKNSIRMLCLLALEFVVSLVVDAYQNAFEKECTTVAQKDTCATKKCITVSGTELCRECVGGKVPIDGICKDTTDSSVSLYGCEHSSGTGFCTSCKDTAFLFYGSCYAIDKVPGNLVCSKAESGKCTECRQGSKFLFTNPDDSAAERCILCYDNVGFGSYKGVDGCRYCLPPLTGETSAECNWCQNEKYGPIDGVCKDPGRHLCADGACSNCYMTHIQHNGGCYTKTETVAQKICTTENQFQVINITACKKCAIKGEVPMDGRCIKGLLEPKCNPYPNTDGSCTDCKKGGVSYDTFLFNEGCYNMSDYIGSQICSKVNENAECELWNIGSYAVFRPPNDKTAHTCSDTSARGIPGCSRCSYNVEKKGPICYNCEYNTLAFDRMSCITETSCTGDNVQRKCPGNSERGCRCECAEKSYKNGDKCVACDSSCLKCAGRESRSCTLCPPGKALKYIGSSMVGTCEEGCKQDDTCETCGLTVNQTAYCSKCKDPTKYPLDGVCTSASEARTSACLQQSNGACQKCSSDYFLMGGGCYQINKYPGRFVCGWADDGKCIETMNGYSINDQGQLVDCDSTCMTCVEGKKEQCLSCHSSKYLKKEGTTSYGTCVSRNDCKDGYYANHDTMECLPCNINDCVSCHLIDKSILCSRCRGDNLVGLDKRSCTTVIPENAVESWGGYTCNDDSVLSGNACLRKSSQKNKGNGLSNNVIIGICVGAVLIMGALIGVLAWWVVSRKKKSASFERSRSLVISKS

SEQ ID NO: 77 - protein, 641 aa, Giardia intestinalis
MLYSDSDSAMWCGGDSDSMRLLFMGGCYNKDAHPGSEICTAASNGVCTECNTANGLFKNPVTPSEKGSECILCSDTIDRNGVMGVAGCSECSHTGTSGPATCTECQAGFVTKDSACVKCGEGCSACSADTPTQCTACVEGKFLKADKCVDANQCDNGKYADPKTGQCKACTDTSVNECATCAYSDTLQKPVCTGCNSGGNLLLKVNPDGSATCVAEAECTSGNTHFLEQSPKACVPCGDTKNGGILGCDTCSSKTTCTKCLDGYYNSASGNTATCTACGENCATCAKDTKDQCTTCKQGYFLKDSSSGECISCSDTANGGRDGCSACSNSGGFKCTDCKPNYKKQLNGDAGDDYTCTKTCEDETACGGTAGACDAIVVGNDGSMLSYCSKCVGAGYGPINGKCTNALAGNTCADGVCTRCTNNYFLYMGGCYKATEVPGSLMCSEATTAGVCTTPNANDRYFVVPEAKATDQSVLACGNPLGTLVDPQGTAKAYVGVDGCSQCTAPAALSDGGMAAAICTSCDSDRKPNRDGSGCFACAVSGCSHCNRDDMCEACNDGKKVSPGRKSCVDKCPSNSTDTDSVCVCDDGYSPDSSGTSCVSMSTNRSGLSAGAIAGIAVAVVVVVGGLVGFLCWWFICRGKA

SEQ ID NO: 78 - protein, 340 aa, Giardia intestinalis
MKGSGPTGECLPCDNAQEGIDGCAECTGPAGSLKCTKCKPNRKPVGTSDNYTCTEKTCEDETACGGTSGACNAIVIDTDGNTKHYCSYCGDSSKYPIDGLCASEAQSNTCNNHVCESCTTGYFLYMNGCYDVSKPPGNLMCSKATTAGVCTEAANNKYFVVPEAKATDQSVLACGNPLGTLIGTQGTAKAYVGVDGCSQCTAPAAPSDGGMTPAVCTSCDNSKKPNLAGSGCFPCAVVGCSHCDMDNKCSACTEGGKRPNKEGTACFECNVEGCAYCSGANKCEECSDGFKLEGDKCVSSGTNRSGLSTGAIAGISVAVVVVVGGLVGFLCWWFVCRGKA

SEQ ID NO: 79 - protein, 887 aa, Giardia intestinalis
MTCKASGIVDCTTCEYNPATGGPKCTACNGAKIVKEEADGTTTCIDAGTCTQSGATGENFLSDGDAECILCSNDSSKTDNNKGSPGCGTCSKNGAKPECKTCLDGYYDSGNGNPAVCVACAGDCGKCGPGGAIDTCEKCKPGFFLKNDGTKKCVPCDDPTDGVPGCATCTLSGSFTCDSCKVNYQKKVGAGGAVTCVKTCEDPTACGGTAGACDAMIIDDQGNTKHYCSYCGETNKIPIDGKCVDSGSINGNTCNSHTCTSCAANYFLYMGGCYKATEVPGSLMCKTADNGVCTAANANNKYFVVPGATNQNQSVLACGNPLGTLVGTQGTAKAYVGVDGCSQCTAPAAPSDGGMTAAICTSCDNSKKPNRDGSGCVLCPVSDCKSCVVDNICEECVDGLYFKAGETPSCVSAEACTNEEGFFIDATEKKCTACADDNCAVCAAKEQQKCSRCKTSGTKKYLMKDGESTTGTCVDTAGCPATHYVDEEAKECNTCVSGGTVDCTTCEKGANGVVCKTCTTDTKTIFGLNRKSCVASCPANSTPKATGQGSQMCECNEGLQPNTESTECQPISNCNTEHCLECTGEGADKEVCTKCLSEYYLTPTSQCVSDCTTLKGYYGNDTDRKCKKCNDACVECKGEGADKCTACPAGRMLQYTDADTPANGGTCMNQCSVSPANDGCAECGAQIGGTAYCSKCKNTQQAPLDGNCAANTRTRFCTTVSNGACTQCENNYFLKDGGCYQTDRQPGKQVCTTVQGGKCTKCASGLTADNGDCSNKRCHLSCETCTAANDANACATCSTGYYKPQSAGTKCNPCSEGLAGCRQCTVSSTGAFMCLVMGDGTGDNTGGSVNRGGLSTGAIAGISVAVIVVVGGLVGFLCWWFICRGKA

SEQ ID NO: 80 - protein, 650 aa, Giardia intestinalis
MIVLCGVLCSVGDSDSVGLLFMGGCYKTESQPGSEICTAAKDGVCTACKADNGLFKNPAAPQKPGSECILCHDATGADGYTGVENCAQCTKSDSNKGAATCTECQDGYYKNAQTCTKCNDACLTCDGSGQNACTSCPEGKYLKGDNTCVDANQCGADKYADKKTWTCKACDPDITGCTACAYEDATGGPVCSTCGSPNSLVKTASDGTTTCVDANGCKEGGMHFVDDGNTKCILCSDTNGGSPNDQGKDNCKKCTKANSGQPPECSACLDGYFFDNSAKTCTNKCAPNCAMCSEATTENKCLTCKEGFFLKVSGTPGQCFACDSVENGGIDGCAECTNSGTFKCTKCKVNYRPSGDSSTGVTCTKICEDETACGGTSGACDAMIIDDQGNTKNYCSYCGDSTKVPIDGLCVSTGSNANGNTCTSHTCTSCAQGYFLYMGGCYSVLTQPGKSMCKTSSKEGICTEAASNKYFLVPEATNAQQSVLACSNPLGTLIGTQDKAKAYVGVDGCSQCTAPTPLTGAGMAPAVCTACSGTNKPNLAGSGCFACAVEGCSHCNRDNMCEKCDNNKKVSPGRKSCVDGCPSNSTDTDSVCVCNDGYSPDDAGASCVSSGANRSGLSTGAIAGISVAVVAVVGGLVGFLCWWFVCRGKA

SEQ ID NO: 81 - protein, 181 aa, Giardia intestinalis
MNGCYDVSKPPGNLMCSKATTAGVCTEAANNKYFVVPEAKATDQSVLACGNPLGTLIGTQGTAKAYVGVDGCSQCTAPTQLEAPGMTSAVCTACDSGRKPNRDGSGCVVCSDTNCKSCVMDGVCGECNSGFSLDNGKCVSSGANRSGLSTGAIAGISVAVVAVVGGLVGFLCWWFVCRGKA

SEQ ID NO: 82 - protein, 662 aa, Giardia intestinalis
MLYSDSDSAMWCGGDSGGVGLLFMGGCYKTESQPGSEICTAAKDGLCTTCNTANGLFKNPATAPKSGSECILCWDTVGDGATKGVEGCATCTAPANNKGAATCTKCQDGYYKNAQTCVKCNEACLTCDGSGQNACTSCPEGKYLKTDSKTCVEASACAKGTYADEATRKCESCTAGSGAGGTAGVQECAACAYNKASGKLECSECTGGAKIPRVSLDGTSTCVAKDYAGCAGQDNALFIVEDKSKCLLCDDVETGTDPKDQGVAGCKACTKTSSAKPTCTECLEGYKSTGVGSVTCTPCHANCATCSAETAEDKCLTCKAGFFLVDVTGGKKCVPCDSKTDNGIDGCAECDNSTGSLKCTKCKVNYKQSGTGPVTCTKTCEDETACGGTSGACDAIVIDDKGNTKHYCSYCGDDSKVPIDGKCVDSGSINGNTCAKGVCTQCAQGYFLYMGGCYKVASPPGNLMCTEATTAGVCTEAANNKYFVVPGASNQNQSVLACGNPLGTLVGTQGTAKAYVGVLNCSQCTAPAALSDGGMAAAICTSCDSDRKPNRDGSGCFACAVSGCSHCNRDDMCEACNDGKKVSPGRKSCVDKCPSNSTDTDSVCVCDDGYSPDSSGTSCVSMSTNRSGLSTGAIAGISVAVIAVVGGLIGFLCWWFLCRGKA

SEQ ID NO: 83 - protein, 589 aa, Giardia intestinalis
MGGCYKVGQDPGNEICTAADKGVCTTCKAGAAYLFQNPASPVAPGNECILCSDTTQRDGVMGVDNCAQCQAPQSAGAATCSTCQDGYFLSDKLCKPCNQNCATCTGAGATNCETCKPGTYLKSDNSCSNTCENNQYADELTMTCKACSEIHADCTACSFDKTTGKPKCTNCGTNKTPRTALDGTSTCVDKTLDGCKGADGALFMKEDKTCALCGDASPDAGVNDKGIAGCSICEKTAGNPPTCSKCLEGYIENTNGGGFACDPCAPGCATCSKKEDPSKCLTCKQGYFLKDSSSGECISCSDTTKGGIEGCAECTNSGTFKCTKCKVNYRPSGEPSTGVTCTKVCEDPTACGGTSGACDAIVIDNTGKELHYCSYCGKDSEFPIDGLCASEAKGNTGCVNNVCTSCTMGYFLYMGGCYSISAQPGKSMCTKAGDGVCTEAAAGYFIPPSPTKDKQSVLSCGNPLGVELAGQKAYVGVDGCSQCTAPTAPSDAGMTPAVCTSCDSDRKPNKDGSGCVTCSVGDCKSCVMDDVCGECSDGYSLEGGKCVSSGANRSGLSTGAIAGISVAVVVVVGGLVGFLCWWFLCRGKA

SEQ ID NO: 84 - protein, 2259 aa, Giardia intestinalis
MCPRFRWPLCSIEFRDMKQDPVRLLMQTRAVLCQLLASMLVGIGLIFAVALADACSPSIDGCAECDSTGKKCTKCDANGNTPYLKKTNPSDPTGTCVSAVDCQGSAGYYTDDSVSDAKECKKCNAPCTACAGTADKCTKCDANGAAPYLKKTNPSDPTGTCVSAVDCQGSAGYYTDDSVSDAKECKKCNAPCTACAGTADKCTKCDANGAAPYLKKTNPSDPTGTCVSAVDCQGSAGYYTDDSVSDAKECKKCNAPCTACAGTADKCTKCDANGAAPYLKKTNPSDPTGTCVSAVDCQGSAGYYTDDSVSDAKECKKCNAPCTACAGTADKCTKCDANGAAPYLKKTNPSDPTGTCVSAVDCQGSAGYYTDDSVSDAKECKKCNAPCTACAGTADKCTKCDANGAAPYLKKTNPSDPTGTCVSAVDCQGSAGYYTDDSVSDAKECKKCNAPCTACAGTADKCTKCDANGAAPYLKKTNPSDPTGTCVSAVDCQGSAGYYTDDSVSDAKECKKCNAPCTACAGTADKCTKCDANGAAPYLKKTNPSDPTGTCVSAVDCQGSAGYYTDDSVSDAKECKKCNAPCTACAGTADKCTKCDANGAAPYLKKTNPSDPTGTCVSAVDCQGSAGYYTDDSVSDAKECKKCNAPCTACAGTADKCTKCDANGAAPYLKKTNPSDPTGTCVSAVDCQGSAGYYTDDSVSDAKECKKCNAPCTACAGTADKCTKCDANGAAPYLKKTNPSDPTGTCVSAVDCQGSAGYYTDDSVSDAKECKKCNAPCTACAGTADKCTKCDANGAAPYLKKTNPSDPTGTCVSAVDCQGSAGYYTDDSVSDAKECKKCNAPCTACAGTADKCTKCDANGAAPYLKKTNPSDPTGTCVSAVDCQGSAGYYTDDSVSDAKECKKCNAPCTACAGTADKCTKCDANGAAPYLKKTNPSDPTGTCVSAVDCQGSAGYYTDDSVSDAKECKKCNAPCTACAGTADKCTKCDANGAAPYLKKTNPSDPTGTCVSAVDCQGSAGYYTDDSVSDAKECKKCNAPCTACAGTADKCTKCDANGAAPYLKKTNPSDPTGTCVSAVDCQGSAGYYTDDSVSDAKECKKCNAPCTACAGTADKCTKCDANGAAPYLKKTNPSDPTGTCVSAVDCQGSAGYYTDDSVSDAKECKKCNAPCTACAGTADKCTKCDANGAAPYLKKTNPSDPTGTCVSAVDCQGSAGYYTDDSVSDAKECKKCNAPCTACAGTADKCTKCDANGAAPYLKKTNPSDPTGTCVSAVDCQGSAGYYTDDSVSDAKECKKCNAPCTACAGTADKCTKCDANGAAPYLKKTNPSDPTGTCVSAVDCQGSAGYYTDDSVSDAKECKKCNAPCTACAGTADKCTKCDANGAAPYLKKTNPSDPTGTCVSAVDCQGSAGYYTDDSVSDAKECKKCNAPCTACAGTADKCTKCDANGAAPYLKKTNPSDPTGTCVSAVDCQGSAGYYTDDSVSDAKECKKCNAPCTACAGTADKCTKCDANGAAPYLKKTNPSDPTGTCVSAVDCQGSAGYYTDDSVSDAKECKKCNAPCTACAGTADKCTKCDANGAAPYLKKTNPSDPTGTCVSAVDCQGSAGYYTDDSVSDAKECKKCNAPCTACAGTADKCTKCDANGAAPYLKKTNPSDPTGTCVSAVDCQGSAGYYTDDSVSDAKECKKCNAPCTACAGTADKCTKCDANGAAPYLKKTNPSDPTGTCVSAVDCQGSAGYYTDDSVSDAKECKKCNAPCTACAGTADKCTKCDANGAAPYLKKTNPSDPTGTCVSAVDCQGSAGYYTDDSVSDAKECKKCAEGQKPNTAGTQCFSCSDANCERCDQNDVCARCSTGAPPENGKCPAATPGCHSSCDGCTENAMTNQADKCTGCKEGRYLKPESAAGQSGACLTAEECTSDKTHFTREKAGDSKGMCLSCSDATHGITGCKKCALKTLSGEAESTVVCSECTDKRLTPSGNACLDNCPAGTYADNINGVSVCASCHATCAECNGDANAASCTACYPGYSLLYGSGTAGTCVKECTGAFITNCADGQCTANVGGAKYCAQCKDGYAPIDGICTTVAAAGRDASVCTAADGKCTKCAGEYTLMSGGCYGVAKLPGKSVCTLASNGKCTMCAANNQAPVQEKCPECSEGCAKCNDSNACTECLPGYYKGAGDKCFKCTASSGNNNQITGVANCVSCAPPAGGNGGPVTCYIKTDGDNTGGSVNKSGLSTGAIAGISVAVVVVVGGLVGFLCWWFICRGKA

SEQ ID NO: 85 - protein, 593 aa, Giardia intestinalis
MGGCYNKDAHPGSDICTQAEGGLCTECNTKNGLFKNPAAAPKPGNECILCWDTVGDGATKGVENCATCTAPGNAGVATCDTCQDGYYKDSLVCMQCDQSCLTCDGSGPNQCTSCKEGKYLKGTECVDKGTCKTDYYPDDTSMTCVACSTIQDCTACTMDQSTGKPKCTNCGSQKIPRTTLDGTSTCVENSYAGCQGTDKELFMKEDQPECLLCGDATTGTDPKDKGVANCRTCTKASATGAAPVCETCKEGYIKNGNGAGATCEACHQNCATCSEATTENKCLTCKEGFFLAGTGEGKCISCENGNDSGYSGLAGCLSCTAPAAPGPASCNRCKIGYTLQGTTCVKTCEDETACGGTSGACDAIVIGANGKELHYCSYCGEANKYPINGVCVSTGNENGNTCAKGVCTQCTTGYFMYMGGCYKVTEVPGKSMCTKAGDGVCTEAAAGYFIPPSPTKDKQSVLACSNPLGVELAGQKAYVGVDGCSQCTAPTAPSDAGMTPAVCTSCDSDRKPNKDGSGCVLCSVGGCKSCVMDDVCGECSDGYSLEGGKCVSSGANRSGLSTGAIAGISVAVVAVVGGLVGFLCWWFLCRGKA

SEQ ID NO: 86 - protein, 593 aa, Giardia intestinalis
MGGCYNKDAHPGSDICTQAEGGLCTECNTKNGLFKNPAAAPKPGNECILCWDTVGDGATKGVENCATCTAPGNAGVATCDTCQDGYYKDSLVCMQCDQSCLTCDGSGPNQCTSCKEGKYLKGTECVDKGTCKTDYYPDDTSMTCVACSTIQDCTACTMDQSTGKPKCTNCGSQKIPRTTLDGTSTCVENSYAGCQGTDKELFMKEDQPECLLCGDATTGTDPKDKGVANCRTCTKASATGAAPVCETCKEGYIKNGNGAGATCEACHQNCATCSEATTENKCLTCKEGFFLAGTGEGKCISCENGNDSGYSGLAGCLSCTAPAAPGPASCNRCKIGYTLQGTTCVKTCEDETACGGTSGACDAIVIGANGKELHYCSYCGEANKYPINGVCVSTGNENGNTCAKGVCTQCTTGYFMYMGGCYKVTEVPGKSMCTKAGDGVCTEAAAGYFIPPSPTKDKQSVLACSNPLGVELAGQKAYVGVDGCSQCTAPTAPSDAGMTPAVCTSCDSDRKPNKDGSGCVLCSVSDCKSCVVDDVCGECVDGYSLDNGKCVSMSTNRSGLSTGAIAGISVAVVVVVGGLVGFLCWWFLCRGKA

SEQ ID NO: 87 - protein, 170 aa, Giardia intestinalis
MCSKATTAGVCTTPNANNRYFIVPEAKATDQSVLACGNPLGTLIGTQDKAKAYVGVDGCSQCTAPTQLEAPGMTSAVCTACDSGRKPNKDGSGCVLCSVGDCKSCVMDDVCGECNSGFSLDSSGASCVSSGANRSGLSTGAIAGISVAVIVVVGGLVGFLCWWFLCRGKA

SEQ ID NO: 88 - protein, 370 aa, Giardia intestinalis
MLLPALCFLMSGLAAQRTKQPTSGCQVDNCERCVPSDETKCEACNSGFDLDENTKQCNPAPAECPIVNCQTCSQDKQTCVACEPGKHLTPTKKACLDACPVGTYLSGQTCAPCDPSCAECSGAGASKCTACPAGKMLRYTDETKLNEGGQCVEQCVEGPECETCGLTIGGTKYCSKCKGSNVPLNGVCTSNAARTQFCTTAADGACTACAAGYFIQEGGCYQTTRLPGKSICTTDNGGKCQTCANGQTPDGGTGVCPLCDSTCKTCTAGQTQQCQTCFSGYYKSGTKCVKCDASDGQITGVTDCVSCAPPSGDSGSVTCYVKMDGSSGGNSTNKSGLSTGAIAGIAVAAVIVVGGLVGFLCWWFICRGKA

SEQ ID NO: 89 - protein, 708 aa, Giardia intestinalis
MLLIALHLVTSILAAPCQPDGDHAASCQTDKCETVGYSEICTECRAGGVPVGGFCWPPGTPQAAAAGCTRADGTALAGSDTICGKCGDGYFLFMGGCYKTSQWSEICTAADKGVCTTCKAGAAYLFQNPASPVAPGNECVLCSDVAPRDGVTGVAGCYTCTAPGGGTGAATCTACQGGYAKKGDACVQCGPGCLTCESATPTQCTACPKGKFLKGTECVEASGCGSDSYADPKVDKCKACATDIADCATCEYNATISQPQCKTCSSSKIVKTAADGTTTCVAEGECTSTHFIDQTPPKACVLCGDDARGGVAGCSSCPGKDQCSACLAGYIKKGSGNSVTCDPCGENCATCTQAGNDKCDTCKPGYFLKQPGSAGKCFACDSKADNGIEGCSQCNSGLTPTCTDCKSNYRKEGTNPVKCTKVCEDPTACGGTSGACGAVVVDSAGAFSQYCSLCGDPATFPIDGVCTGTKGDNTCENGVCTRCAAGFFLYMGGCYDVSKAPGSHMCKTAEGGRCTAPSENGRYFLVPGASNTDQSVLACENPLGTVIGAGSTAKAYVGVYGCTACTAPAALEAPGMTPATCTACSGNNKPNLAGSGCFTCTVDGCSHCGAGGKCEACTSKDQRPNTDGSQCIACSIDGCVRCSEENKCGRCGDDYRLEGEACVSTKPSGGNRSGLSTGAIAGISVAVVVVVAGLVGFLCWWFICRGKA

SEQ ID NO: 90 - protein, 615 aa, Giardia intestinalis
MGGCYKTSQWSEICTAADKGVCTTCKAGAAYLFQNPASPVAPGNECVLCSDVAPRDGVTGVAGCYTCTAPGGGTGAATCTACQGGYAKKGDACVQCGPGCLTCESATPTQCTACPKGKFLKGTECVEASGCGSDSYADPKVDKCKACATDIADCATCEYNATISQPQCKTCSSSKIVKTAADGTTTCVAEGECTSTHFIDQTPPKACVLCGDDARGGVAGCSSCPGKDQCSACLAGYIKKGSGNSVTCDPCGENCATCTQAGNDKCDTCKPGYFLKQPGSAGKCFACDSKADNGIEGCSQCNSGLTPTCTDCKSNYRKEGTNPVKCTKVCEDPTACGGTSGACGAVVVDSAGAFSQYCSLCGDPATFPIDGVCTGTKGDNTCENGVCTRCAAGFFLYMGGCYDVSKAPGSHMCKTAEGGRCTAPSENGRYFLVPGASNTDQSVLACENPLGTVIGAGSTAKAYVGVYGCTACTAPAALEAPGMTPATCTACSGNNKPNLAGSGCFTCTVDGCSHCGAGGKCEACTSKDQRPNTDGSQCIACSIDGCVRCSEENKCGRCGDDYRLEGEACVSTKPSGGNRSGLSTGAIAGISVAVVVVVAGLVGFLCWWFICRGKA

SEQ ID NO: 91 - protein, 807 aa, Giardia intestinalis
MILASLIVILTCFLAGSFSEETFVYYNGFGYSCEGRIPQCLQDRCLVDLTTFFCTECSQDYVPINGTCVATTDEKVNKAGCVKSPKGGWCTGCNNGYFLFYGGCYELSGRWKASICDRAENGICQECGKGGGYYTPITFTNPNATSPERCIYCGDIVGFGGSSGVYRCQYCNQHRLPGNTIPSCSECSERVMCPFDFRCKPASSTAVFGYCYVCPRGYVWSQFGCYTADSIIGNSICLPRNTIDIQGRSLCTQCANSSEAPQNGLCKSISEFGNVCTKDPRTGKCTSCKNDSSGQYFLFYGGCYLFNNAPNQIESYICQAMQGNVCTTCNSSTKEVFTKNSRCWRCGDSANGGIEGCQRCEMKDSGLQCLECRDLYLSLDKRSCLASCPKGQKGVQESSSSVHSCACDDGSYLKDGKCVGCAVENCAECDESSCKKCKYGYTLSSSQCVATKCKDPNCDTCEDRDVCTKCTDGNSLDPHGLCVKDCLGSAGYYKATVGGVSRCVACTLGNCVVCESESKCKTCRDGFYVEGSGGCKPCSSECATCSGPASGDCTSCPARKRLQYSDGAKGSCVPQCVKDSSCAECGLTVSGTSYCSRCAKSTEYPNNGVCTSSSSRAAGTACVNVADGRCALCSSNSFSLNGGCYTSTLLPGKTVCTKENNGWCDSIVAGYGITYNGTLLTCPTNCAMCSSGVCNACNSGFYLEKGACKACSKGCATCPHGKACFDCLTGYYFSENTCKACHKAISKCSLCVVPEGAATPICLEYDNTSKKSALSSSAISGIAIGVVLVVGGVAAVLVWFFVFRKKN

SEQ ID NO: 92 - protein, 937 aa, Giardia intestinalis
MSWSSLFALLIIAMHAHDEVCARCLHDKCLQTRHGSVCTHCETGYVPLEGRCTATDVSFCLVESEGGGTCSQCAYGYRGLLNGCYPVPLFGVLDGNVSAASAFYISTHVLLNGQILFTGCFANNELPINGVCAEDTDNWCAQSGETDFSYGTSCLRCTGTNVFYFKGGCYNTKTEPGSLICKAALDGVCTACNTDSGYVFENPSTGTKTDQCISCGDGYGADGYSGVESCKTCVAPSGNSKIATCSACPDGYKFNIAHTRCFNCALQGCLNCDGYDSCEHCDTGFFMADQSYSKICVTTCPSGTFPFVNSTGYNKCFSCSSSDGSDSIAVERIPGCETCAVGSGNLLTCSACLQGYQLTPTGCKQVCADVLGCGLDACTVVIGSMSYCSKCKSTNNYAPINGVCEYVSMNDKSGCRREETIAGVCPQCGEGYFLHMNGCYKADQAPGNLVCSSVGTGSRSLRNAGAGLCSVCGSGYRAKHGRCISCNKQHCLEYIPNTCVCTLCEDNVLLIQGECVSFPSSGCKVPYCALCEKKLEVCTRCEASYYITPLHGCTKDCEDLMGYHNNADLGKCVRCRIRNCYKCYDSARCSECSTGYGLTDNQQCVRCPKNCFACAHHNKCTTCKSGYILSDSEVCESEDEYKVDCKHADAKYIKYEFARHIKGSVRQRLTASMCSECNAGKVPINGKCVSVSAKAPSCTPGTGENAGKCTRCISSGSSNSTFLYSGGCYDSNTNVGKSLCASVGDNGLCARCPRGGFMLDTSRNECVPCPMNCMKCNSSGCLRCDSGWLLIESECVPCKKGCLECGSSSDKCTSCITGYYVAGATTSSGKEGICRRCDDTQEVDGWKGIQGCTLCTPPVFAGEVLCLSKEVIEDVVTRSLSSGVVAGISITIVVVVAAIVGVLVWKYVCKKKSSKRIKMVDMDVSINTSQYMSTSTV

SEQ ID NO: 93 - protein, 454 aa, Giardia intestinalis
MQMSRKFLLAIFILQLAWAVQVEDEREEAASDNVSTSGIYSFTIEDKRYCPQCNHSEDNPDSISREHVVNNTINSKEAEEEPTKCGENLYLKVDSGTTSCVAGEDCGTGSFPGTDSAGNRKCISCSDSANGGIQHCSECSLLAPTSRSVTVLITCSKCSANNLSPLGDKCLRKCPFGTYDNGDNVCARCHESCASCNNSPEPTSCTSCYPGFVLDHAGGPAGTCIPECTGRYAENCEAGQCTAVVGTSKYCSKCKTGYVPVDGICVSTATREVMGCTPGNDGTCTACTGTYFLQSGGCYQSTAYPGMRLCEQAQDGKCTKCANLQAVDKQGSCPLCETGCDLCGTSRTTACQACFPGYYHSGTKCFKCTDDSDESGVKITGAPNCVSCEPPNPGKSGPVTCYVTQQPNNDNTGWSMNSNALSPGAITGISITVILIIGGVAGFLCWWFFCHKKK

SEQ ID NO: 94 - protein, 734 aa, Giardia intestinalis
MFGSFVLAGVLVQIALAEKVTERARQAECADKTNDCEICDVLIDGKLYCSRCNTGFVPINGKCADKEGAKANCKGADGGDTADRTCAQCAEQTFMYKGSCYQTSQAPGSSMCKTAADGKCTEALESKAYFVPPGADKTHDSVVSCGDATGVTLADKTYKGVDGCTACDAPAPADASGAKVATCTACQADKYLKTATDPATSCVTEKECTDAPGFFVDTTDGKKCSKCAETCKTCKTEAAKCTSCNGDKPYLKKDGESTTGTCVDAKGCPETHYVDEGAKECNTCVSAGTTDCTTCEKGPTGVVCKTCTSGTKTKFGLGKKSCVENCPSNSNDEKTAGTCECVDGYVLNGAGTGCTKKPDPQCNTPGCKTCSEPKTSKEVCTECEGPKALTPTGQCIDNCGDLGGYYAGTNEGGKKACKKCEVENCLLCNLQGQCDTCKDGYYKSGAACAKCDTSCKTCANGNSNGCTSCEPKKALSYEGEGNTGTCKSECKPGTNNCEKCELTVDGTAYCSKCKDANQFPQNGVCSAAAGKAITCTTQGGGVCNKCANGLLRMNGGCYETTKLPGKNVCEEVTQDGDTCKTEAPGYHLNNNDLVTCSPGCKTCTSNTVCTTCMYGYVKTDNKCTKCATGCATCAGSASNCDICSTGYYKSGTTCVSCTANTADSTITGVANCASCAPPLNDKGSVLCYLVQSGENTNKGGLSTGAIAGIAVAVIIVVGGLVGFLCWWFMCRGKA

SEQ ID NO: 95 - protein, 2076 aa, Giardia intestinalis
MLFAALAVLFSSASSPGCIDPTQNPDGEYECQHGGVCTRFETLLSSGFICDCPRGSFGRACNFCDRSFMLINDRCVSPACVLDGVSVCGGSGECLYTEDTDSWSCSCRDGFVNIAGTCVSSSCINPESPDLICSGNGSCRSLPGGETGDDYLCDCNDLHLGDHCEACNRRTSKPVTTNGVTECVSLECFTEDEELPCGGHGHCGSYPVDGKLSYTCMCGFGYSLVNKTCVASSCIFEYSNGHHVCGYDDSFKTACVESAQGEWSCRCPSDTTFMDGYGCVSSQCIENSGEPPCGGVGGCYVFQISGETKTYKCQCPHYTVGNFCKTCSPNEATNIDGVCVPNDCIYGNTSCNDHGVCHSLLVHSFCECESEFDTVDEMKHYCGIPECHDPNTKMLCSGAGACNEQTRVCVCINGFQYQSYGGCVPDKLINENGVCNGRGTASLKDPWDLPANEKLNATNPEHWICVCGTLYTGETCDQCNPSTSFTPTASPPESQPTGAPPQLPTCTPRDCYNDGYELKDPDPPVDPNQPSDPTYIDQPTKLCTNPLQENNSPLGTCESYKIEDEDMFICTSNDPNQYQQAYNSSSIYPVACTTPGQHYVRQNFMCGLLQGKTAPLEIRMVSCSTTETNGYNCTCNGEYNWVSRTINGVIHYSCMHDECLNDGATSGSSDINDYCSGLGDCILDLTGTTHTCACSANAVFYKNKCIPRACVSGWKDEQTPIICGGRGTCTHWGDGDWGCKCMDVDHYTYVSGGCYPNSCVYLWQNPTDGASYIQLCGGDSVVAGGTCIVDEADPSKSYCECNADFVRYGQTCVHKKCTSVDYHNDFQVTPDSICSGNGYCLFNSRTNMSTCFCTKGTAYGPFCSVEPCITNIEYEFGDTWGEITLNCGRPGAGVCNITGESTGECSCNPDYELLPPTSEHPELAKICVNTGCIDNGVYCGGDLAAVCGISRAVATCLCSQAFEAVNNTCVPKMCYAPNPDGMMAVCGGVGTCEKESGSNVYSCKCPTSGYTAAQMKYNGNTVWTCAPQSCVNGTDSSATVCGGTTGGSCVGSGGQYRCSCSDGFFLITPTQCVSNNCLSQNMNGQISVCSGVGTCSESTMGMFTEYYCTGCTTGFKAIDGKCVSESCYFQIDSLSKYYVCGKLGNFGECVGTGSGFTCSCSYGFFLAEKYCVPNQCTDNRRHPAECGGHGECKLKSLAEFTCVCNANYETVDTDELGLHYCVAQACMVKDNGVVTSICNGHGLCRKDRCSCYEGYADDPSASTNDPTGNCTVCATGYKEYPAPNTLTAIAANANCVKNNCGRSTQDDDCGGSTVANNPSCVYSSKTSTYECSCKTGHYSNNGICKVSSCTDGDSTVECGGSQFGTCDNTNNICTCVSGMVLVKPYLCVSPRCISNSATNEVCNGHGTCAINPRTQIAACRCTDDYVTARDGLCYLSTCFNDPEHSQPVVCDGADNSCNTGGECSCTPPFVKFAGQNGCVHSNCIQNGVVCGGRGVCRANLLYTQYSCFCNDEYILASDGTCQPRSCSRDGVTVCDNNGTCEADASGSTYSCKCNGTTILYMNGCVPRACFPQYNPRASLCGGNGLCDMSSGMCQCNSDASLTDELLCQPTDCVNPQYSATVCTNNGVCNSVSNVCLCVEGSSGKYCESCASGYKKYTSNDEYNGRCVKDSCGSKNCGTPGKCIFDSDIIEYRCLCNDGFYYSTSEQECRRCLMDNCVTCNGESSCAVCEDGYYSNGGRCRECDDDCRTCSGPEESHCLSCMPGKVHSTGVGPANCIDECKENEDGCATCGSVIAGSRYCSVCRGQTSFPLEGTCHAKTSRAGDACESVVAGRCTRCLGNYFLYEGGCYSSSRLPGSQVCSVVLGGNCLKCADGYYKAGSDVEHACVSCDGLMEGCTKCMASGCTECKAGYYPDTSNGRCMECASPCKTCNGAGGRCTSCAKGYFAQFMADDLNNYGECRNCSNTTADNGLVGVRNCKECVVFAVGSLSQPEMVHCSEFSSVKSSAGVIAGSVIAVLLVLGGVIGFCVWWFLVRGKKGQAAQKGRRGKSYSGRKYVRTVSDPDSTSLLSTDMTNSLL

SEQ ID NO: 96 - protein, 96 aa, Giardia intestinalis
MTAAVCTSCDSGKKPNKDGSGCVVCSDTNCKSCVVDGVCGECNSGFSLDNGKCVSMSTNKSGLSTGAIAGISVAAVVVVGGLVGFLCWWFVCRGKA

SEQ ID NO: 97 - protein, 2169 aa, Giardia intestinalis
MLTGLVLSLALASLELRASAASTITTAAEFSAIRDNLAGSYILGADITLDPSYEPISGFTGTLDGANYKLTISGQTGSSGVFGDQFSGSVRNLRLNYAATMSSPLTNPVGALIGVTTGSATVESVFVEGTMTLSGTGDATITVGGVIGSATETTTLRNITSTVSIACTGGSHSIGGVVGTSSVGCAKCFFGGSISATAAEASVIGGVFGTAGGVSLTNSAMYKGSLSATSVSTSQASALGALVGNITAADFTLCECYAEFTSLSLTSSSVAYLGGLIGSFSSATSKDTVTISDSYVNGGTQTLTATGSFSTSAGLLGYSASGKVTVRSSYVNLTKFAMSGSSQINATLSVGTANTNTGLTLENCHLKAQTVGLSGGTSKSSFAPIANVVNVQAKGISILEVESRLGALVLTDFKGLVSLVVGRFVTTTGGKMQDCFASLDSCTLGSSSSKVALFYTYTAANAVSSYIIANVTCAEITKAFSSQKSDAGISHNYFNSNAACVATVADKYIGLTDSTMKQSASYPGIDLGTWNIDGSHYPHLKRTPHYRDGAYTLDDRSKWAVDVWEIGQGMRLKRTTPPSSCNSANLHCDRTQYVDLFSCQCVVGCPNLINGQCIGPDEARCDPGFKLDDAKNCTLYSCVTATEECRLSDGSSGATCNVEFDTCVCSDVTKYYDHTNKMCVDGCTGLVGGICIGQNTATCYPGWVADGNSLCAKYDCSTLPEGDSTICGGPSIATCDFTSKLCVCEDKRQYYDPSLANPGCKSGCSGGVQYGVCSGSGQAVCIEHVTSVAGATAGDLLCTEYSCDTISCGAQAECDSELKVCRCPLSSQYYNLKSHACVEGCLSLAEGVCVGQNRAKCRPGYGSHNGVLCGAYSCANDNSNRKCGGLGTCEGGQCVCSQGAVLFRGTCREGLCKNGNVVNGVCQCLDGWSSPATEDQIEASGYCSVYTCPPDGTLIELATPGSLLAIRACPSHGFRLTSDIDARSYEWEGVDFSGTLDGNNHAISGINLRVSSLGSEYSASFFKHLTGQVRNIRLVFASSPDASAIGQDSVCKFGLLSISADASAVLENVAISGSLSLQVPASVAAEVGGVFHTCPSAPTAVSNSVAMTCSGANCTMGGYCHTVSAPLTGGTSTATLRCQATDGTVCIAGGFAYVVRAPISNILSAATISLVPAADIAVQSARVSAGGIAAVLSEGASASDCQFSGCIAREQGSLNPALVVHSGGAFYMVSGTAAAKTVIERCTVTSNELSGIEMAGFAGNLIHATVRDCSAIVTKIDGLQGVSGFAQYVNDSVIERSFVKANASVTAEGQKKWIVGGFCGLVANSQILNTYAELGNFSSRNTPAGSSVGGFVGRVENSVIRDSFVRATLLEAVSGMSGTSQWTFGGFAGFVDHVSAGPMEIQRCFGDIANLSMSTAVSVYFGAFGGQIRKKSSSKAVTSKTISNVWINANVECTFVVPKDTSKAPSNGVGMFAGKMYNGVALSLAMINGSLTCRGANPPSMASSLYHIGLFNGAKTSDSSTSAEFVIINVTAGDIPGIGLKGEPEDKLICLTCFANGDLLTPVAPSSIAVDPDPNLKTAEELRKLSTYTGFGIGISESKWTKSPGEFPFLNSLPVKVLIDDQDKYIYPTCTQDCWDYTSFWVLSSSGPTTDNNKNSCADIENCMVYSSDCTCSQCNLKYYPSGSECLACSTGCQTCRSTDFCEICEDGQVSNGAGVCIAPSCDFRYCQTCSNDGATCETCSIRAFKASTGQCERCSEGCKQCTDSTVCATCGDDNYKPDPENNVCVCKDGFYSSERKCLQCNRACQTCTGGTERDCIACSEGWVRDDATSTCTPQCAEISGCLLCPSPPACGTCLSDYDLVDGSCILRGSCRVDNCLTCVAGNVNSCASCRDGFYGSNCAACPERCAACVSAERCTACKSGYVLSPGEQCVSCSISNCGQCSSDNFCFSCNDGYYLNAGACPPCNVPCKTCVNSADKCTSCQSGYELSVNTCISTTACDVENCRSCISAGVCGRCNTGYYLSGSRCSRCNSMCRECFGPNTCTECAAANAIPDEDGICVSTVCNVSNCLRCDLVTLRICTMCDSGYTLSSGNTCEPNAPPANKTSGVAVGVSVFVVIVVIAVIVIIVVFLKKGIIKGRKPKHNLGISSRHSNSMLSYDNLNESVSAPLL

SEQ ID NO: 98 - protein, 736 aa, Giardia intestinalis
MLGLLFLGAVVSSTADVFGQECTTAAQKDTCATKKCITVSGTELCRECVGGKVPIDGICKDTTDSSVSLYGCEHSSGTGFCTSCKDTAFLFYGSCYAIDKVPGNLVCSKAESGKCTECRQGSKFLFTNPDDSAAERCILCYDNVGFGSYKGVDGCRYCLPPLTGETSAECNWCQNEKYGPIDGVCKEPSRHLCADGACSNCYMTHIQHNGGCYTKTETVAQKICTTENQFQVINITACKKCAIKGEVPMDGRCIKGLLEPKCNPYPNTDGSCTNCTRSGVNYNTFLFNGGCYNMSDYIGSQICTKVNDRAECDAWNTGDYGVFKLPDYHMAYPCSNTSAGGIQGCSRCRYNNTEKKVICYDCEYDTLAFDGMSCITETNCNGDHRQRKCPGSSKRGCRCECMDKYYRSGEQCSACASSCLRCNNQEANSCTLCPSGQALAYNGDGTTGTCKAGCTPDSTCEACGLEVDQTKYCSKCKDSAQYPLNGACTPASNARASACLRQSDGACQQCSSGYFLMGGGCYQVSKYPGRFVCKRADGGKCVDTTDEYNINSKGELVDCNSNCETCVKGQKTQCLSCHSNKYLKKEGTTSYGTCVSRNDCKDGYYANHDTMECLPCNINDCVTCHLIDKSILCSLCRGTSLVGLDKRSCTTIAPENAVEFWGRYVCNEDSVLSGNACVRKDSQDTGRLSNKASIGIGVGVSVVVLVLIGVLIWWLVFQRRRGSGFGGSRDMLTSRD

SEQ ID NO: 99 - protein, 71 aa, Giardia intestinalis
MDACPENSAENPASAYACSSGYSPDTNGTSCVSTDVRLSTGAIAGISVAVIVVVGGLVGFLYWWFICRGKA

SEQ ID NO: 100 - protein, 226 aa, Giardia intestinalis
MAHCKADGCSLNVGGSKYCDQCEEGYAPVDGVCTSIPATARDASGCKASGGKCTECGANYALLSGGCYNTQKLPGSSVCTAAQNKGQCQTCANGQTYADKNCPTCTEGCVKCAGSKETCTDCLAGYYKTIDNKCVKCTASSGDNNQITGVENCISCAPPAGGSGPVTCYVTQQKADDGTGGDTGGDSTNRSGLSTGAIAGISVAVVAVVGGLVGFLCWWFVCRGKA

SEQ ID NO: 101 - protein, 130 aa, Giardia intestinalis
MTAAVCTACTNNNKPNLAGSGCFACTVDGCSHCGAGDKCEACTSKDQRPNTDGTKCIACNIDGCVRCSEENKCGQCSDGYRLEGGRCVSSGANRSGLSAGAIAGISVAVVAVVGGLVGFLCWWFVCRGKA

SEQ ID NO: 102 - protein, 419 aa, Giardia intestinalis
MLVGFLLVCATVLAKHNGKNGCEKASNTACEERLTQAGCETCTGVGQDQTCLTCGGGKKVQLNGVSCDATCPQNSAANDQNVCVCNPGFSLNNGKTACEKASNTQCNTPNCKACDNPKTDNEICTECNDGNYLTPTKQCTQSCGAIGSYYNGDKECEPCDPSCAGCTTKGPAKCTACPPGKMLKYTNDDPNQGGSCVDECKAEVDGCAECGAVIGGTKYCSKCKEDKWAPQNGVCANSVTRNSFCTNAAGGVCTQCAADHFLQDGGCYKLGRQPGEQICTLADSNGGCQTCANSLQPNNGACPSCHSTCKTCRDANSANACTTCATGYYMVGLDPGTCTSCESDSGSVKGVAGCMSCAPPSNNQGSVLCYLKNGDSTGGSTNRSGLSTGAIAGISVAVIVVVGGLVGFLCWWFLCRGKA

SEQ ID NO: 103 - protein, 836 aa, Giardia intestinalis
MTLVVSLLLLYGIFSECAQNSDCGGATGVCNVTIGGKKYCSKCDGARVPVNGDCRLLSLSRSICIVPTDSTPTPGSCSGCIRDFLFYRGGCYRTASLINAICKEKHIVEEGMYCGACAIEGDVPIDGVCVAASADSSGNTCDKGVCTTCGNGYFFHYGSCYKFGGSPGANICSDSTSTTGSVCGSCGSKFVKNPSAGPSATSCFACYGLDGTLFCERCRMNVLTSTDVKPTLCTKCKSGHIPLDGRCISAFSAASALAGCSTYKGSDNAMGLCETCSSGYMLFYGSCYSVNGPLAQAICKTENQIYLGGRVFCKQCAQTDHYPINGLCIADKGSHTCEAGICTACDTSTTPVDNSKVFPFYNGCYDANSAIGKLICQEASNGACSTCNTNETSNIIANPNSADGQPKCLGCWDEAATGVANCGGCATGTDGDSKIVCSKCTDSTEPKDNTCPQALPPTTPEGCAVQGCQACSKDSATTCDTCFSPLVMKEDKTKCFGSCLALGLGYYNDAGVCRPCTSKCLTCTDGTTCTQCAEGYYLEVSGAGSTTGTCKACAAGCSTCTGAGDSLCSTCVTGYYAAFNVRQGGPGKCVQCSVSEDGYTGVEHCAACYSTTGQTTGAKNVVCESCEDGYLKEHVDNKVVCNPPAPKCTVPLCAICVENDAMRCEHCTTGAYLCPRTAACTKDCASCGGSMYPDEDLGECQPCDITNCLVCATGLKCESCAENAVPISPDVYHTACMGCSDTGGMDGWVGLAGCTTCELTDKGGGSVNCLDPGYYRRGGLGGGAIAAIVIVVLLVLAVAGFLVWWFVFRRGGRPKRGAKYTSLMRGESYDYRQSLI

SEQ ID NO: 104 - protein, 1144 aa, Giardia intestinalis
MLAVLGLLIAFQAAKCTHSNQVSDCAEDRCEEINGHELCTECRNAGYIPFNGHCIKYDSEQHSSCKSADGTPIVSEKRCGMCTDSMYLYKGGCYACGNLYPGNLICSECDKGVCKSCTSGFFRNPAASQTVDSCVRCDDTTGVADFVGVAGCLHCLSPSKSKGPDVALCVKCKLSTHKPNPNGDICYRCEIPDCPRCAADDSCAVCGRGYLKGTTKRVCVSQCGVGFYVAPTQLRQCKKCSGACQTCEGPNETDCTSCNESEGYFLAAENGTGRCVSCGDEQGHAGWKGVANCKTCIPPSTPGVVKCTTCELGHSPINGKCEVECGEPSGYCEENSCNVAWSDDLLCSRCIEGYAPIEGMCNVVTPDHGSGCVANKGRCEKCGLWYFLYQGGCYNVWLGYNHFVCLEAGAKPEEIGLCKRCASGFRNEKGICVRCRDPYCKTCIQDTNTCESCIDGYYDPSFCKRCHDDCETCVGEGPRRCLTCPSKKYLLPIYKNIGVCVDGSQCGYGMYGDISSQKCLPCSAGCATCRSSRDDECISCYLRTHFFVPTGQNRGKCIECGDTTNPKGINGCRECAMENDLVKCLSCRVGYILVNGKCQSHCEDPNCAAGSCMVGIGEELYCSLCKTDGHAPVDGICTDVTSAHPSGCVTGVGFDSARSCIRCGAGYFLYMGGCYQENKEPGKSICTWAGVPGYVNGNNYGLGLCNACAAGYENQDGVCRPCTTVNCERCRMDDQGEVCTHCMVGYVLDQAGTCTTKTMGSCTVPDCAECTEGKKCRRCGPGFFLTSVGTCVDNCRSIPGHYALDATEKSPARCALCEIPNCKECGAGKLCAVCSDGYFSDNGVCTPCDSTCATCVAKGPSSCVSCPSGYAVTSESGVGECKKPCTPSADGCKRCDASIDGASYCSVCSAQTAFPLNGKCVGLSARAGSACVSVVDGACTSCADGYFLLSGGCYQVDTYPGRTVCHAEERGVCTKGAHGKMVSESGILQECSIANCAECTADACVTCRLGYVSVDGQCQKCAQGCVTCIAPDNPQMCTLCDTGYYQSTTGSAFTCTACGADNNGMKGVNGCTCCMPPEGKVGSVLCYSFDALPSIIPTPKPSPDPVPSSTRKTAFIAGVSVTAVLLVTGLVSFLLWWFLCRRSR

SEQ ID NO: 105 - protein, 1151 aa, Giardia intestinalis
MLAVLGLLIAFQAAKCTHSNQVSDCAEDRCEEINGHELCTECRNAGYIPFNGHCIKYDSEQHSSCKSADGTPIVSEKRCGMCTDSMYLYKGGCYACGNLYPGNLICSECDKGVCKSCTSGFFRNPAASQTVDSCVRCDDTTGVADFVGVAGCLHCLSPSKSKGPDVALCVKCKLSTHKPNPNGDICYRCEIPDCPRCAADDSCAVCGRGYLKGTTKRVCVSQCGVGFYVAPTQLRQCKKCSGACQTCEGPNETDCTSCNESEGYFLAAENGTGRCVSCGDEQGHAGWKGVANCKACTRPSTPGVVECTECESNRLLIDGQCRKECDDPSEYCEADACDVVWRNELLCSRCKEGHAPLNGMCSELTPNNRRACIASKGRCEKCGPGFFFHQGGCYQVELEEKNFVCVEVGTKPEEIGLCKTCASGFRNDKGICVRCRDPYCKTCAQDTNTCESCIDGYYDPRFCKRCHNDCKTCVGESPEQCLTCHPKKYLSPIHKNIGVCVDAWQCGYGMYGHPFALKCLPCSEGCATCRGSEENDCTSCHLRTHFFVLTGYNRGQCIECGDTTNPKGINGCRECSAKGDSVRCIACKAGYVLVGGKCLSHCEDPNCAAGSCVVGIGEKLYCSLCKTDEHAPVDGICTNVASAHPSGCVTGVGFDSARSCLQCGAGYFLYMGGCYQESKEPGKSICTWAGVPGYVNGNNYGLGLCNACAAGYENQDGVCRPCTTVNCERCRMDDQGEVCTHCMVGYVLDQAGTCTTKTMGSCTVPDCAECTEGKKCRRCGPGFFLTSVGTCVDNCRSIPGHYALDATEKSPARCALCEISNCKECGAGNFCAVCSDGYFSDNGVCTPCDSTCATCVAKGPSSCVSCPSGYAVTSESGVGECKKPCTPSADGCKRCDASIDGASYCSVCSVQTAFPLNGKCVGPSARAGSACVSVVDGACTSCADGYFLLSGGCYQVDTYPGRTVCHAEERGVCTKGAHGKMVSESGILQECSIANCAECTADACVRCKLGYVSVDGQCQKCAQGCVTCIAPDNPQMCTLCDTGYYQSTTGSAFTCTACGADNNGMKGVNGCTCCMPPEGKVGSVLCYSFDALPSIIPTPKPGPDPVPDPVPAPAPSSARKTAMIAGVSVTAILLVTGLVSFLLWWFLCKRT

SEQ ID NO: 106 - protein, 428 aa, Giardia intestinalis
MINRSSRAAMLLLVLCFLMSALAAQCKGHQHSNCATGWCRAVRGVEVCMRCKAGHVLIDGVCADNSVVYGAGSACQILNCKQCNADNTQCEQCEDGYTPSAGNTQCNENPEARCNTPNCKTCDNPKTGNEICTKCNDGDYLTPTNQCAHDCTAISGYYGDTDKKCKPCSPECAECVGPANNQCSACPAGKALTYGGGDPAQGGTCGDACTADKNGCKVCGARIGGTDYCSQCSVGTQAPLNGVCTANARAQFCTQVTSGSCTSCSGGYFLKNGGCYQADRQPGKQICTLADSNGGCQACANGLPPSSSDVCPSCHFTCKTCSTADIANTCTTCATGYYMVGSGPNTCISCESDSGSVKGVAGCMSCAPPSSNTGSVLCYLMNGDSAGGSTNKSGLSTGAIAGISVAVIVVVGGLVGFLCWWFICRGKA

SEQ ID NO: 107 - protein, 120 aa, Giardia intestinalis
MCSSGVCNACNSGFYLEKGACKACSKGCATCPHGEACFDCLAGYYFSESTCKACHKAISKCSLCMVPEGAATPICLEYDNTSKKSALSSSAISGIAISVVLVVGGVAGVLVWFFVFRKKN

SEQ ID NO: 108 - protein, 806 aa, Giardia intestinalis
MTLASLIVILTCFLAGSFSEETFVYYNGFGYSCEGKISQCLQDRCLVDLGAFFCTECSQDYVPINGTCVATTDEKVNKAGCVKSPKGGWCTGCKNGYFLFYGGCYELSGRWKASICDRAENGICQECGKGSTYYTPITFTNPNATSPERCIYCGDIVGFGGSSGVYRCQYCNQHRLPGNTIPSCSECSERFMCPFDFRCRSVKGLELGYCYFCPRGYVWSQFGCYTTDSVIGNSICLPRNTIDIQGQSLCTQCANSSEVPQNGLCGSISGFDNVCTKDSETGKCTSCKNDSNRQYFLFYGGCYLFSYAPGQVGSQICQTVQNNVCTACNSSINEVFTKNNGCWRCGDSANGGIEGCQRCEMKDSSLQCLECRDLYLSLDKRSCLASCPKGQKGIKGSSSSVHSCACDDGSYLKDGKCVGCAVENCAECDESSCKKCKYGYTLSGSQCVATKCKDPNCDTCEDRNVCTKCAGGNSLDPHGLCVKDCLGSAGYYKATVGGVSRCVACTLGNCAVCESESKCKTCRDGFYVEGSGGCKPCSSECATCSGPASGDCTSCPARKRLQYSDGAKGSCVPQCVQDSSCAECGLTVGGTSYCSRCAKSTEYPNNGACTFSSLRAAGIACANVAAGRCAACSSNSFSLNGGCYTSTLLPGKTVCTKESNGWCDSTVTGYGITYNGTLLTCPTNCAMCSSGVCNACNSGFYLEKGACKACSKGCATCPHGEVCFDCLAGYYFSESTCKACHKAISKCSLCVVPEGAATPVCLEYDSTSKKSALSSSAISGIAISVVLVVGGVAGVLVWFFVFRKKN

SEQ ID NO: 109 - protein, 308 aa, Giardia intestinalis
MVTCSGCETKRLSPLNDACLEECPAGTYPDNRDSTGICASCHNTCASCSTNAETSCTACYPGYVLNRSSGDTGTCIKECTGDFMAHCKADGCSLNVGGSKYCDQCEDGYAPVDGVCTKVASTTRDASGCKASGGKCTECGANYALLSGGCYNTNKVPGNSVCTLSVGGKCTMCVASGADPKGQACPTCPDGCLKCTGNVGSQTCSVCLSGYYLSTNKCFRCTAGDGASANAITGVENCISCAPPTGGNGGSVTCYVKNDDSTGDNTGGSTNKSGLSTGAIAGIAVAAVVVVGGLVGFLCWWFIGRRKA

SEQ ID NO: 110 - protein, 827 aa, Giardia intestinalis
MLGLLPLALLASLCKSSRDVYYNKFGVGCEGKQENCAQDRCILLGSDQLCTQCVPGYVPIDGKCQKYPGASSPPCTPDDPASPTRCIACKQETNIFLFYGSCYKITTTQDRNLGNFLCSEASNGVCTECYKNNTEMYVFTNPDTSAAEKCILCSDTVGFNGYKGASGCLDCLPPITDKIGIALCVKCHYTDKDRHFYPIDYQCQAKGPHNCVNGYCTSCYKTHLFYEYGCYSRHSSTGFAICVEANQYELDNVTICKECANASYAPRNGACILIKENPSIEEIAFKCTKDPTKGLCTACPASAKSFLFYGGCYDEDAHISSRLCSRIGSNACEQWNSAFKWIFSKNGDNNKNGYLCGDIANGGISGCATCNYASGAVTCTRCSAGCLGVDGKSCSEGCSGDTRGVCTKVAEGSESTEVSCRCVCKPTFYNSSGTCISCTDSCAVCKDGTLTGCQQCSPGKILNFSIVSSESADCINQCSVSSECAECGITIDGSRYCTRCKDASTYPFNGVCIPNTQRDAYCTSTANGACTTCSGAAFLMNGGCYTTEHYPGSTICDKQSNGKCEKTKEGYGISDDGKLLECDPTCLACTAPGPGHCTRCPSGALLKRASGAATGSCVDPGACGDGYYAYGDACLPCATPGCKTCGHASFCTECAGELFVSLDGQSCLGECTGDKVVGEVSGGVRRCWCERGFLPALDRSGCVLPTECPPDMPLCAACDESGRCLLCVTSGHNVQVDQRTCAEGCGARASSNQGLCMCELDAVLTKGVCVPAKELARKRTAAIAGGTVAGVAVIGVLVGFLCWWFLCRGKRIGASPSTTALVRPKSV

SEQ ID NO: 111 - protein, 852 aa, Giardia intestinalis
MGSLKALDRYWAVLSQCTCGSFGSHWMVRRDCNGATRCTNMTYTLRQPQFYSAQSTSFWPCAEIADCRVVFAIDPVSVDSISACGQRVPEGSINCINQRGLTDVPRVCSYQSINRAMFGSFVLAGVLVQIAWAEKVTERAAQCADNTNCAAEACNVLIGGKLYCSQCNTGFVPINGQCAGKEDAKTKCKDTDGGDTADQTCGQCAEQTFMYKGGCYEAAQQPGQTICQAAENGKCTQAKAGYFVPPGADASHQSVIPCGDEEEITVKNDKKYKGVVHCTQCNAPAEAADANAKAATCTACGDSKIVKTAKDQATSCVTEKECTDAPGFFVDTTSGKKCSKCAETCKTCKTEAAKCTSCKDDKPYLKKDDESTTGTCVDANGCPATHYVDKEAKECNTCVSGGTVDCTTCEKGANGVVCKTCTTGTKTKFGLGKKSCVENCPSNSSDEKTPGTCECVEGYVPDDAGTGCTKKSDPQCNTPGCKTCSDPKKDKEVCTECEDPKALTPTGQCIDNCGDLGGYYEGTNEGGKKACKKCEVENCLLCNGQGQCETCKDGYYKSGAACAKCDTSCKTCANGKPNGCTSCEPKQVLSYEGEGTGTYKPECKPVSGGKDGTCKSCDLSIDGTSYCSACNVGTEYPENGVCVKKSARTASCQVEPSNGVCGTCAKGFFRMNGGCYETTKLPGKNVCEEAAPTGDTCQTPADGYKLNNGALITCSAGCKTCTSQDQCDTCKAGYAKTGGNTKKCVPCATGCSECNADDATKCTVCAAGYYLSKEKCIACDKSDGGSITGVANCANCAPPTNNKGPVLCYLIQNTNRSGLSTGAIAGISVAVIAVVGGLVGFLCWWFICRGKA

SEQ ID NO: 112 - protein, 606 aa, Giardia intestinalis
MLYSDSDSDSAMWCGGDSGGVGLFFMGGCYKTESQPGSDICTAASNGVCTTCKADNGLFKNPVTPQKPGSECILCSDTKGADGYTGVANCLKCTEPTNSPGAATCTECQEGYYKENNECNQCDQSCLTCSGSGPNHCTSCKEGKYLKSDNTCSPTCEGNTYADPVTRTCKESGIADCTACEYNTTVSKPQCTACNNKKVKTELDGTTTCVDDAGCATDNVDGSHFLSDDSTKCILCSDTTTGTEANDKGIANCKTCKKNGAKPTCSACLDGYFGSDTCTACGANCATCSAAGNDQCTKCKPGFFMKQPGSTGECVACDSKADNGIEGCSACTNDGGAFKCTDCKPNYRKEGSTGSVTCTKTCEDDTTCGGTSGACDAMIIDDQGTTKHYCSYCGDSSQAPIDGLCATDKNGNTCTNNVCTSCTQGYFLYMDGCYSTQSQPGNLMCKTANNGVCTAVNENNKYFIVPEAKPTQQSVLACGNPLGTLVDTKAYVGVDGCSQCTAPTAPSEGGMTPAVCTSCDSGKKPNRDGTGCVTCSDTNCKSCAMDGVCGECNSGFSLDNGKCVSTGANRSGLSTGAIAGISVAVVVVVGGLVGFLCWWFVCRGKA

SEQ ID NO: 113 - protein, 397 aa, Giardia intestinalis
MKEDQSACLLCGDNTEDTSESNKNQGTPNCKTCTKTASTKPVCETCKDGFFFNTGDKTCTNKCDATCKTCSAATDANRCLTCMPGYFPIDSTDQQGKKCVPCDSVDDKGREGCSVCSNNGGFKCTECKVNYKKQSNGDAGDDYTCVKTCEDPTACGGTSGACDAIVIDNDGVEHHYCSYCGNQGDVPINGICTSSLASNTCADGVCKSCAQGYFMYMGGCYDVSKAPGSHMCKKADNNGICTEAASNRYFVVPGAQTTDQSVLACGNPLGTLVGTQGTAKAYVGVDGCSQCTAPAGLSEGGMTPAVCTSCDNSKKPNKDGSGCVLCSDTNCKSCVMDGVCGECNSGFSLDNGKCVSSGANRSGLSTGAIAGISVAVIAVVGGLVGFLCWWFVCRGKA

SEQ ID NO: 114 - protein, 185 aa, Giardia intestinalis
MTGSGQRSVSAPVILLPVTGEHQEAFSLHGLPCTADAMFAKLIFTSLVLQLAEAIRPAEKSRSDNACGDLGTAGCATCDSNSGNKICLTCTDPAKFIAVNKKSCKAACDANGGEIEAPVVGSTKACKCDEDNGYTLQGDACVIPNTNKSSGLSTGAIAGIAVAAVIVVGGLVGFLCWWFLCRGKA

SEQ ID NO: 115 - protein, 1299 aa, Giardia intestinalis
MMSFFVALLPALLRCGQCGSTIPHCLDCLDLDNNYCRRCQEGFLPVDGLCLGGNASIPCTSHLGGTCVGCRPGYFLFHDGDQMGACVICSHAVLKLGPGCKDCVLVGGVPHCLACHSTYFGINVMSDSGATLLQCTTLSERRMPLQRRHKGLFVSPGQATCTVQNCRVCASQAPNICIQCTRGYSLKDEGRTCICGVPHCTTCSPTDGQQCTQCDANYALTPHRACVCSVRNCIQCGSQGTARCQKCITGYRLSEDGSTCSCGVDNCAFCSSTDGAQCVTCVTGYVQSYSQRSCTCAVEHCAECFPADGSQCVRCVTNYVLSHDFKVCASSLENCLYPSPVNGSVCSICSSGYVTAFSGEVCLSVKCQVLYCEECDGVLCAQCIKGYSLVNDGLGCACNALNCLICNPDDGDLCLVCVGGYDVTPDGLCECAIRNCATCSQDGRSCKACINGYRKGEGGCECLIDACKTCSPQDGQLCDECHLNYDLVHGACVGKIPGCLVASPIYEGSCEFCNTNWELFHGRCFCKIRNCNKCHENGKMCIQCANGFVLQADNTECACTLTNCAECDPEDGTKCLACKTSYTLDSSGQCTTSTCSIDNCKNCGQSNVCAECNDNYELSTNSQTCTCLLLNCSKCRPSNGQQCLECVTGYKLDLSMNQCICDVQLCETCNSSDGALCDTCITGFIKGPTSATCNCAADNCRVCNLSDGTKCEICNLGYTLTGTACQPNVANCKQYSLSRGCIECERGYSLMPSNAECLCTVQNCATCSPTNGSECTSCVQNYTPQEGLCLCMVQECLECDSANGNLCNVCVYNYALSEDRTTCACDVKNCILCIARDGKKCFMCEKGYRLTETSACEEIPCSVENCLSCPPGNPDYCIVCQRGYWPTKNGNECACSDPACGECDFENGEICLHCNANYREFQNKCLCSLPYCTKCDINDGSQCEECENGFMLTPTKACILRVCFTNQDNCKVCGTGAHADKCLTCVSGYVPIDGVCVQDSKQDVCNQYSGTCTGCAPTYFLWQNGCYPCNMIPNCIECYMTKTYGPLCTMCEPFYTLRGGKCQLNPYCSQGCVCNGELQCTDCIAGYTMISNICTLCESLFYMCAECSKTFCTRCFGGYSISYHDCVPGVCRENAHGCLVCANDYTCARCRSEMYLYRGACRECNFAGSNCADCTFDKEYKCLRCLEGYTQVVSNGVSYCVKCPDIDHCLECAYNSTRSSQFQCTTCADPWLVDTATGTCFIRNASSASTATAISCSVIGAAIAIATTIALIVKCQHHRHARMVRQVDALVTEADELAH

SEQ ID NO: 116 - protein, 128 aa, Giardia intestinalis
MLLLVLCFLMSALAAQCKGRQHSNCATDQCRAGHVPIDVCADSSAVYGAGSECTDPNCKRCDQNPAECEECNSGFDLDGSTKQCISSNTNKSSGLSTGAIAGIAVAAVIIVGGLVGFLCWWFLCRGKA

SEQ ID NO: 117 - protein, 748 aa, Giardia intestinalis
MLVGFLLVFTVTQAHRTSVSTDCPIENCQTCSSDKATCEACKPGFVASGDNRACNPAPADCPIENCQTCSSDKATCEACKPGFVASGDNRACNPAPADCPIENCQTCSSDKATCEACKPGFVASGDNRACNPAPADCPIENCQTCSSDKATCEACKPGFVASGDNRACNPAPADCPIENCQTCSSDKATCEACKPGFVASGDNRACNPAPADCPIENCQTCSSDKATCEACKPGFVASGDNRACNPAPADCPIENCQTCSSDKATCEACKPGFVASGDNRACNPAPADCPIENCQTCSSDKATCEACKPGFVASGDNRACNPAPADCPIENCQTCSSDKATCEACKPGFVASGDNRACNPAPADCPIENCQTCSSDKATCEACKPGFVASGDNRACNPAPADCPIENCQTCSSDKATCEACKPGFVASGDNRACNPAPADCPIENCQTCSSDKQTCEACEPGKHLTPTKKACLDACPVGTYLSGQTCAPCDPSCAECSGAGASKCTACPAGKMLRYADESKLNEGGTCVEQCVEGPECETCGLTIGGTKYCSKCKGSNVPLNGVCTSNAARTLFCTTAANGACTVCAAGYFIQEGGCYKTDRLPGKSICTTPTGDGKCQTCANGLTAVSNMCPLCDSTCATCTVANQPDKCSACPPGRYLDASKACKLCTETSGSIQGVANCASCDPPTGNSGSVICYVKTDGTDNGGSVNKSGLSTGAIAGISVAVIVVVGGLVGFLCWWFLCRGKA

SEQ ID NO: 118 - protein, 587 aa, Giardia intestinalis
MLVGFLLVCATVLAKDSGKDTCFPGYTLNPTTKKCDRNSAPCEVEGCDVCEESNPQQCKTCGSGYTLNPTTKKCDRNSAPCEVEGCDVCEESNPQQCKTCGSGYTLNPTTKKCDRNSAPCEVEGCDVCEESNPQQCKTCGSGYTLNPTTKKCDRNSAPCEVEGCDVCEESNPQQCKTCGSGYTLNPTTKKCDRNSAPCEVEGCDVCEESNPQQCKTCGSGYTLNPTTKKCDRNSAPCEVEGCDVCEESNPQQCKTCGSGYTLNPTTKKCDRNSAPCDTPNCKACDNPKTDNEICTECNDNNYLTPTSQCVSDCTTLKGYYGDDSGKKTCKRCNDACAECKGEGADKCTACPAGKMLQYTDADTPANGGTCMNQCSVSPANDGCAECGAQIGGTAYCSKCKNTQQAPLDGNCAANTRTRFCTTVSNGACTQCENNYFLKDGGCYQTNRQPGKQVCTQANGGKCQTCANGLAATDGNCAECHPTCATCSTAGTADKCKTCATGYYKENGSDTTTGLCKKCSEKISGCKQCVSSSGSSVICLESEVGTGGSVNKSGLSTGAIAGISVAVIVVVGGLVGFLCWWFLCRGKA

SEQ ID NO: 119 - protein, 1167 aa, Giardia intestinalis
MIILLGILFASQAAKCTHSYQVNDCAEDHCEEINGHELCTECKNDGYIPFNGYCLKYDSGRYSSCKNADGSAITNQKKCGMCTGSMHLYKGGCYSCGNFYPGNLICKECDRGVCTSCTSNFFKNPAASQTVDSCVRCDDTTGVSGYVGVTDCLRCSLPSNSKVAKCRTCKLSTHKPNLEGNACYKCRTPDCYRCKADNACEVCGNFKYLQGTTKPYCVSACGVGFYSVSVPSLQCKKCSATCRACEGPNERDCTACRESENYFLAATNGVGKCISCGDERGYSGWMGVANCKTCYPPNGPGVATCNKCERGYSLVDGKCKADCDDTSGQCAAKGCHVTIGDKSFCSLCNTGYAPVDGICTTVQPDNPSGCVANNGQCNKCGAGYFLYYGGCYSGSTEVHKTICLEVGTESDRVGLCKTCADGFQNKDGVCILCWDPDCKVCSKDTTKCEVCRDGYYDPEFCKRCHSSCKTCMGESSKQCLTCPSNQYLRPIYDNAGMCVESTNCGYGMYGDSSSYKCVSCSAGCLTCKAAGDDKCTSCPIRTHFLDGSESGAGRCIECGNTTNAKGIDGCRECTMESDSVKCLVCKAGYTLVNGKCQSHCQDSNCAAGSCVVGIGENLYCSLCKTDGHAPVDGICTDVTSAHPSGCVTGVGSDSARSCLQCGAGYFLYMGGCYQENKEPGKSVCTWVGIVGSVNKNNYGLGLCNACAAGYENQDGICRPCTTVNCERCRMDDQRDVCTHCMVGYVLDQAGTCTTKTTGSCTVPDCAECADGRKCRRCGPGFFLTSVGTCVGNCRNIPGYYALDATGEAPARCALCEIPNCKECGAGKLCAVCSDGYFSDNGVCTPCDSTCATCVAKGPSSCVSCPSGYAVTSESGVGECKKPCTPSADGCKRCDASIDGASYCSVCSVQTAFPLNGKCVGLSARAGSACVSVVDGACTSCADGYFLLSGGCYQVDTYPGRTVCHAEERGVCTKGAHGKMVSESGILQECSIANCAECTADACVTCRLGYVSVNGQCQKCAQGCVTCTAPDNPQMCTLCDTGYYQSTTGSAFTCTACGADNNGMKGVDGCTYCMPPEGKVGSVLCYSFDALPSIIPTPAPAPAPAPSSTRKTAMIAGVSVAAVLLVGSVVGFLLWWFLYRRTQPYGAKHVALSRKRIPTTASITTPLN

SEQ ID NO: 120 - protein, 102 aa, Giardia intestinalis
MLYKLQDIHGHPTLADRATHIYSFDALPSIIPTPAPAPAPSSTRKTAMIAGVSVAAVLLVGSVVGFLLWWFLYRRTQPYGAKHVALSRKRIPTTASITTPLN

SEQ ID NO: 121 - protein, 213 aa, Giardia intestinalis
MNGCYDVSKAPGNLMCKTAANGVCTTPNANNRYFIVPEAQATDQSVLACGNPLGTLIGTDSTAKAYVGVDGCSQCKAPTQLDTPGMAAAVCTSCDSSKKPNKDGSGCFTCAVSGCSHCNRDNMCEACSSGKKVSPGRKSCVDGCPSNSTDTDSVCVCSDGYSPDDAGTSCVSSGANRSGLSTGAIAGISVAVIAVVGGLVGFLCWWFLCRGKA

SEQ ID NO: 122 - protein, 1335 aa, Giardia intestinalis
MLVFSVGLLALRIARIKGFSSVETATSDLKCYHSLKLGEDTVCTDCMTFNTVPINGICVPDDPNICITLQGYNTKCGSCTSDYMLFEDGCYDLNGKYAPLICAVENRYVLGGATYCSQCAYLDYVPVNGICDSANPFDTCANNVCTKCGFSSFLFNGGCVSKSSSLGKLVCAGTVSDGKCTQCADGFSTDATGMCIPCEVPNCSSCPNGKSTCSSCKEGFFLDSTGVCMLCRHHCAVCSSKDDCDKCRANAQELMIGSKRVCIGCGDTSSQHEGYLGIEFCSQCTLPSTPGPVQCHKCFQNYYSLTDSATGFVSCYAACPIGTYGDAYSMSCRSCSANCKICESSHSCTECTPGYYPGFMSCVPCKVSGCSRCTSGYAGDTCEMCLPETPYMNLAGTECIAACPTGSKPDTSTPTKCICDFGYGLAENKNACMNCSDRYCKLCAEDPSVCTECFYGTKADGAVECPPPVCADNCVSCAQAGHNFCDICQEGFRLTADLKCARCSDENCLTCANDAAVCTGCQYGFRLSSSGTCIQCGSGCKVCNESMCIECSNTAHFVSIDGVSCDTECPSHSTPVSDSNASRCVCNNGYTPELEARLCVEEPKVCPLGCICESAPVCSGCADGFFEKDPDRTDSGRCHSCALTTDSQGDQTTTGCKICRLVEDTILCSECLPNYKLYDSNGVVHCMKTCPSGTHDTGSHCVKCLTNNCMQCNADKTVCEVCVHDYYLWENECISCSSLECAECGLLNTCTKCMSTKKCRACAIPHCRTCNALGKCTVCEKGFYGPMCQPCGGNCLTCSSENPGLCLECQSGSIMSMGKCYNMCTEGEGSGKCAIGSCDMQTGACMRCSVLSEFPINGLCTSDPRGNNCLAGRCIECTAGYFFHGNGCYSIAAVPGNGICVASLRGYCTACHDGYSLQKDECVLCKVSGCAKCVSDPTICELCTIKAYVVDPAGSSCVPKCAVPSFGVSSSSKHCVLCTDQNCLECTDLADNCSRCKIGYHLVEGTCVACHSTCLTCSGPGESDCLTCIKGKAHSAGTGSSTCTDACVENSRNCLLCNAVIFGTAYCSQCTSGHYPINGDCHMAARDLICLNGKNGICTHCAPGYFLYSGGCYQSDRLPGSYVCAQSATDEGLGVCSKCQLGYGPLSGSCTPCESTNCQACEYSSNICTVCSDGYYGDSCVQCPKTCASCKSNLQCTQCAEGYFAATDYEVFDPSHCVACSDEEGKNGYVGMQGCLSCVGPAVPGPILCLSEAGPYVPVVPPASNARLSLTIGLSVTAVALLLIALGILLWKLLSARKLSRTRCMHLPGSTTELLAGASGTGQSMIFDSINLSIT

SEQ ID NO: 123 - protein, 530 aa, Giardia intestinalis
MTNGPSRAAMLLLVLCFLMSALAAQRTKQPTSDCGVANCAQCNADGRTCDQCSEGYNLNQEKTQCTKACAVANCAQCNADGRTCDQCSEGYNLNQEKTQCTKACAVANCAQCNADGRTCDQCSEGYNLNQEKTQCTKACAVANCAQCNADGRTCDQCSEGYNLNQEKTQCTKACAVANCAQCNADGRTCDQCSEGYNLNQEKTQCTKNPEARCNTPNCKTCDSPKTDSEICTECNNGNYLTPTKQCTQSCGTIGSYYNGDKVCEPCDPSCAACITKGPAKCTLCPPGKRLQYTDEGATQNGGSCVDECKPEGGASGCETCGATIGGTKYCSKCSTSTEVPVNGVCTADNARAAACKVKDGKGGCTTCESGYFLQDGGCYKLGRQPGEQICTAASSAGKCETCANSLQPNNGACPSCHSTCKTCRDANSANACTTCAAGYYMVGSAAGPCTSCDSNSGSVKGVAGCMSCAPPSSSTGSVLCYLMNGDSAGGSTNKSGLSTGAIAGISVAVIVVVGGLVGFLCWWFLCRGKA

SEQ ID NO: 124 - protein, 209 aa, Giardia intestinalis
MQFFMIFALAAASGRTISMRFSKRRRISTQAPLNGNCAANPRAAFCATITSGACTQCNEGYFLKDGGCYQTDRQPGKQVCSSAQGGTCQTCANGLQVQSGACGECHSTCATCSTADDPNKCKTCATGYYKTSDNDGPCMKCSEGLAGCRQCTASSTDAFMCLEMGDGTGDNTGGSTNKSSLSTGAIAGISVAVIVVVGGLVGFLCRRET

SEQ ID NO: 125 - protein, 499 aa, Giardia intestinalis
MQCDQSCLTCDGSGPNQCTSCPEGKYLKTDKSCVNNNGCTGNTYADPVTMTCKDSAITDCTTCEYNATVSKPQCTACNNNKKVKTAIDGTTTCVTVTSDCVDENHFKADDDSACYLCSDSSGSGNDQGKDNCKKCAKASGQPPVCSECLDGYFFNTNTKTCTDKCADNCATCSAETAEDKCLTCKAGFFLVEVAKPAGKCVPCDSKTDNGIEGCAECDNSTGSLKCTKCKPNRKPAGNQDNYTCTEKTCEDPTACGGTAGSCDATVIDNQGNAKHYCSYCGEANKFPIDGICVESSQKNGNNCNSHTCTSCAANYFLYMGGCYSTQKAPGSFMCSKADSSGICTEAASNKYFVVPGASNQNQSVLACGNPLGTLIGTGNTAKAYVGVDGCSRCTAPTALTTAGMTVAVCTSCDSSKKPNRDGSGCVLCSVSDCKSCVVDDVCGECVDGYSLDNGKCVSMSTNRSGLSTGAIAGISVAVIAVVGGLVGFLCWWFICRGKA

SEQ ID NO: 126 - protein, 427 aa, Giardia intestinalis
MKEDKTCALCSDVTDSTLGNEGKANCKTCTKTGSDNPTCSACLDGYFFDSGTSTCTDKCGDNCATCSVAGDPNKCETCKTGYFLVTTTDQQGKKCVPCDSVDDKGREGCSVCSNNGAFKCTDCKPNYRKEGSTGSVTCTKICEDDTACGGTSGACDAIVIDDKGVEHHYCSYCGEANTYPIDGKCNSAKANNQCDQGVCTQCTNNYFLYMGGCYKVDTVPGQHMCKTAANGVCTAVNANNRYFIVPGATNQNQSVLACENPLGTLVGTGDTSKAYVGVDGCSACTAPAAPSETGMTAAVCTACTNNNKPNLAGSGCFACTVDGCSHCGAGDKCEACTSKDQRPNTDGTKCIACNIDGCVRCSEENKCGQCGDDYRLEGEACVSTKPSGGNRSGLSTGAIAGISVAVIAVVGGLVGFLCWWFVCRGKA

SEQ ID NO: 127 - protein, 887 aa, Giardia intestinalis
MTCKASAITDCTTCEYNPATGGPKCTACNGAKIVKEEADGTTTCIDAGTCTQSGATGENFLSDGDAECILCSNDSSKTDNNKGSPGCGTCSKNGAKPECKTCLDGYYDSGNGNPAVCVACAGDCGKCGPGGAIDTCEKCKPGFFLKNDGAKKCVPCDDPTDGVPGCATCTLSGSFTCDSCKVNYQKKVGAGGAVTCEKTCEDPTACGGTSGACDAIVIDNTGKEHHYCSYCGKDSEFPINGLCVGNEKKEGNNCNNHTCTSCTTGYFLYMGGCYSVSTQPGKSMCKTAANGVCTAVNENNKYFLVPGASNAQQSVLACGNSLGTLVDPQGTAKAYVGVDGCSQCTAPTALTTAGMTVAVCTACDSGKKPNKGGSGCVTCSVGDCKSCVVDNICGECVDGFYFKAGDAPSCVSAEACTNEEGFFIDATEKKCTACADDNCAVCVAKEQQKCSLCKTSGTKKYLKKDGESTTGTCVDTAGCPATHYVDEEAKECNTCVSAGTTDCTTCEKGANGVVCKTCTTDTKTIFGLNRKSCVASCPANSTPKATGQDSQVCECNEGLQPNTESTECQPISNCNTEHCLECTSEGADKEVCTKCLSEYYLTPTSQCVSDCTTLKGYYGNDTDRKCKKCNDACVECKGEGADKCTACPAGRMLQYTDADTPANGGTCMNQCSVSSTNDGCAECGAQIGGTAYCSKCKNTQQAPLDGNCAANTRTRFCTTVSNGACTQCENNYFFKDGGCYQTDRQPGKQVCTTVQGGKCTKCASGLTADNGDCSNKRCHLSCETCTAANDANACATCSTGYYKPQSAGTKCNPCSEGLAGCRQCTVSSTGAFMCFVMGDGTGDNTGGSVNKSGLSTGAIAGISVAVIAVVGGLVGFLCWWFLCRGKA

SEQ ID NO: 128 - protein, 824 aa, Giardia intestinalis
MSRSLSVLLLVCLLAEFFSEEAPIYRNGFGYFCEGKIPNCLPNSCILGVTSRFLCTECESGYVPIDGKCVLAGDSKATRSGCAKSQTGGWCTKCGDDHFVFYGGCYNLSQDWTKFICERAEKGICVECAKTNETQPSVAFTNPSTSTPERCISCGDTVGFGGYSGIYGCLVCNSSRIKQEVVPNCYQCSDHKNTCSYDYRCKHITEGASNGLCGYCPETHIWSFYACYARDTPISNSICLPENIMEMSGQSLCSRCTNPSEIPLNGLCLSITGFEDICVKDPESGRCTSCKNEGNRQYFLFYGGCYLFKDVSDQIESQICQAVKENVCTACNSSTKEVFTKNNGCWRCGDSANGGIEGCQRCEMKDSSLQCLECRDLYLSLDKRSCLASCPKGQKGVQESSSSVHSCACDDESYLKDGKCVGCAVENCAECDESSCKKCKYGYTLSDSQCVATKCKDPNCDTCEDRDVCTKCTDGNSLDPHGLCVKDCLGSAGYYKATVGGVSRCVACTLGNCAVCESESKCKACRDGLYVEGSGGCKPCSSECATCSGPASGDCTSCPAKRRLQYSDGAKGSCVPQCVQDSSCAECGLTVGGTSYCSRCVKSTEYPNNGACTSSSSRAAGIACANVAAGRCVVCSSNSFRLNGGCYTSTLLPGKTVCTKASDGWCDSTVAGYGITYNGTLLTCPTNCAMCSGGACSACNSGFYLEKGACKACSKGCATCPHGEACFDCLAGYYFSESTCKACHKAISKCSLCVVPEGAVKPICLEYDNTSKKSALSSSAISGIAIGVVLVVGGVAAVLVWFFVFRKKAGVPLLYKQSIVASTH

SEQ ID NO: 129 - protein, 142 aa, Giardia intestinalis
MLVGFLLVCATVLAKDSGKTACVASNTNCASGLDTAGCKTCAGAEPDQTCLDCKVSGQNVQLDKRSCAVGCPLNSAANDQKVCVCDQGFSLNDGKTACVSSGTNKSNGLSTGAIAGIVVAAVIVIGGLVGFLCWWFLCRGKA

SEQ ID NO: 130 - protein, 636 aa, Giardia intestinalis
MLLVAFYFVLSALTAACQSDAQIAKCTQCVKISTSDTEICTECKAEGDVPINGVCTPKGDATVTTAGCKTDAGAEITTEKTCGQCDGAYFLHKNGCYAIGGDVGRLICADAAAAGRVSSKTPGVCEGCVVGYFKNPSAANNKDSCIACNDATGVVDGGNTYKGILNCATCQPPASAGAARQDKVAVCESCLEGFFVDSNGAACTACQDNNCAKCDAGAGKCTKCKATANKPYLKKGETEDSNTCVDKSGCNDNSHFTDDADDPTNGKMCKKCSEGIADCKTCALKDNPEGTILITCSACIAGTNQPNADGTKCVLCDIQDCIKCNEENMCEECTGGKSLSPLKNMCMEGCPAGTRDVSGICTNCHNSCAECDGDSEASCTACYPGLVLSKSNTGATGTCIPECTGRYAENCEAGQCTAVVGGSKYCSRCKAGFAPVDGVCVSTTTRAVTGCMPNDNNDGTCKACTTTYFLQSGGCYQSAAYPGSNLCSNAQNGKCTNCANGQQPEASTGSCPACASGCKTCEVANKEACKTCLPGYYLAGAKCVKCDTNDPNDGSHIVGVPNCVSCAPPTGGNGGPVTCYVKTDVTNDGGNDNNGGNTNKSGLSTGAIAGISVAVIVVVGGLVGFLCWWFICRGKA

SEQ ID NO: 131 - protein, 699 aa, Giardia intestinalis
MLLLAPCLLISALAASCSGPTASKCKDGECDMIGKTEVCTQCKTETDHLIDGECVPAGTDQAAAKCASPAQGKCGSCGDGYFMYKGGCYEFAGELGGLICADPAGGATVGKVTGVCKDCVEGFFKSPVAAANKQSCISCNDTTGADQYQGVDQCKTCNPPSNTGPATCTACDEGYFGAGTTTCIACGDENCATCTEATTTKKCSKCKATGKMYLKKESGSLTGICVEGNQCSTDSTLYPDDTEPKSCKPCTAGTFENCKTCTKSDTSVTCTACKENMVFGLGKKSCISSCPDNSEAKTENTCTCNDGFKLNEEETQCVPNDSPSNPCSTQDCKACSGAQTNKEICTECLSNKYLTPTNQCIDHCEYILGYYSSTEGNKRVCKKCEVANCLACSENGGCGLCKDGFYGEACSPCDSSCKTCSGNTANDCTSCKSGSTLTYGSTGNTGTCGAECAAGTGTGKCRECGLTVEGTKYCSVCSQNNEYPQNGVCAVKASRTDKCKDGSITGGVCNVCADGFFKMNGGCYSTSQLPGSTVCLSAQSTGGICKTPEEGFSLTGESLVTCYTGCAECTTTKDCSRCMDGYVKVGSACTKCHESCYTCEAGATTCKVCAPGYYKESSSNGPCRKCSEGLAGCRQCATPVNGKFICFETDDNTGDNTGGSTNKSGLSTGAIAGISVAVIVVVGGLVGFLCWWFICRGKA

SEQ ID NO: 132 - protein, 102 aa, Giardia intestinalis
MQRAATTCKVCATGYYKTVLGEGACTFCEGNSNGVTGINGCVSCAPPSGNTGPVLCYLMKDSRNTNKSGLSTGAIAGIVVAVVIVEGLVGFLCRWFLCRSKA

SEQ ID NO: 133 - protein, 95 aa, Giardia intestinalis
MASGYYIDGSINLVVCSDGCAKCTTSSTCTTCKDGYAKIGSSQTCTKCDSSCETCNGQLQRVRYVRQDTTRLYWEKARAHSAKVIAMGSLVSMAA

SEQ ID NO: 134 - protein, 71 aa, Giardia intestinalis
MCALVTSQSGAALITCTTYVVGYKLSADETKCEAASNCKTPGCKTCNNEGKENEVCTEYASGNYLTRRASA

SEQ ID NO: 135 - protein, 72 aa, Giardia intestinalis
MFGRLLLASAVLQLTWAACEANGLGGAGSCKTCGATIGGSEYCSECNDGANYAPVDGICANAGQTPASTLCP

SEQ ID NO: 136 - protein, 400 aa, Giardia intestinalis
MLLSEAHKQHVNRAPMLLPALCFLMSGLAAQRTKQPAPSCQVDNCEQCNADNVHCDRCVPSDDTKCERCNEGFTVSDDKTVCNQSPAQCNTPNCKTCDNPKTDNEICTKCNDGDYLTPTNQCVPDCTAISGYYGDTDKKCKACNPECAECVGPANNQCTACPVGKMLQYTDTNTPVNGGTCMDQCSVSSTNDGCAECGAQIGGTAYCSKCKNTQQAPLNGNCAASSRVAFCATITSGACTKCNEGYFLKDGGCYQTDRQPGKQVCSNAQGGNGKCQTCANGLAASDGNCAECHSTCATCSTADAADKCKTCATGYYKENGDDTTAGLCKKCSEKISGCKQCVSSSGSSVICLESEVGTGGSVNKSGLSTGAIAGISVAVIVIVGGLVGFLCWWFLCRGKA

SEQ ID NO: 137 - protein, 128 aa, Giardia intestinalis
MAAAICTSCDNSKKPNKDGSGCFTCTIDGCSHCNRDNMCEACSDGKKVSPGRKSCVDKCPSNSTDTDSVCVCNDGYSPDSSGTSCASSGTNRSGLSTGAIAGISVAVVVVVGGLVGFLCWWFICRGKA

SEQ ID NO: 138 - protein, 438 aa, Giardia intestinalis
MYVIDSKSGMLQVPVAVFTSWTQAHINRLMFEKILLGIAILQMARASTCQAQSGGDPGTCEKCDALIGQTKYCSKCNGANYAPVNGACEDVETQEDKKALCKAHASGACTTCGGASFMYKDGCYSKDTEPGQSMCTQASEGKCTEAAPGYFAPVGAANTEQSVVACGDTTGVTIAAGGNTYKGIADCAECGAPDATAGAEAGKVATCTKCGVSKYLKDNTCVDKAQCDSGNTNKLVAVDDPENGNKCVSCSDNLNGGVANCDTCSYDEQSKKIKCTKCTDNNYLKTTSEGTSCVQKDQCKDGFFPKDDSSAGNKCLPCNDSTDGIANCATCALVSGRSGAALVTCSACIDGKRPNKEGAACFECNMEGCVYCSGANKCEECSDGFKLEGDKCVSSGSAGVNKSGLSTGAIAGISVAVIAVVAGLVGFLCWWFVCRGKA

SEQ ID NO: 139 - protein, 620 aa, Giardia intestinalis
MLVVELLFVLNVLAANCAGGTRNSRATGNQCGTIEGISSPMECAEGHALDEAANACRAPPSFQCEVDKLVTIGSAQACTQCKQGFAPIDGVCTAFGDDLVTKTAKCTQSGGAAIEGTDTSCGKCGGDGYFLFMGGCYKTGASPGELICTNAVGGVCAACKADGSVFQNKASVKTPGSECILCSDSVGADSNKGVANCAACDAPTGDTGTAKCKACAEGHALDEAANACRAPPSFQCEVDKLVTIGSAQACTQCKQGFAPIDGVCTAFGDDLVTKTAKCTQSGGAAIEGTDTSCGKCGGDGYFLFMGGCYKTGASPGELICTNAVGGVCAACKADGSVFQNKASVKTPGSECILCSDSVGADSNKGVANCAACDAPTGDTGTAKCKACAEGHALDEAANACRAPPSFQCEVDKLVTIGSAQACTQCKQGFAPIDGVCTAFGDDLVTKTAKCTQSGGAAIEGTDTSCGKCGGDGYFLFMGGCYKTGASPGELICTNAVGGVCAACKADGSVFQNKASVKTPGSECILCSDSVGADSNKGVANCAACDAPTGDTGTAKCKACAEGHALDEAANACVSSGGAGGSVNKGGLSTGAIAGITVAVVVVVGGLAGFLCWWFICRGKA

SEQ ID NO: 140 - protein, 680 aa, Giardia intestinalis
MFQLIPLFVASALMAACQPDGNHTATCAQNKCETVGSAEICTECRAGGVPVDGFCRPPGSPQAAAAGCTQADGTALDKTATTCEKCGDGYFLFMGGCYKTTDGPGSEICTAASNGVCTTCKADNGLFKNPATAPEKGRECILCHDATGADGYMGVEGCATCTAPTNNKGAATCTECQDGYYNDGGACKKCVDGCIDCTGANQCTTCEDGKYLKNNQCVDAGQCDQGTYADPTTGQCKPCGITDCATCEYNATISQPQCKTCSTSSNKMVKTAADGTTTCVDDGGCTNGNTHFVEGTNQKLCVPCGDTTNGGVLGCSTCSSKTTCTKCLDGYYDNDDSQDTATCVACGGQNCETCAKATSDKCTTCKPGFFLKDSSSGECISCSDTANGGREGCSVCSNDSGFKCTDCKPNYKKQLNGGADDDYTCVKTCEDDTACGGTSGACDAIVINENGKELHYCSYCGDNSKYPIDGKCTNVNAGNTGCTNNVCKSCTAGYFLYMGGCYKIGAEPGNLMCKTAEGGKCTAVNANNRYFVVPEAQATDQSVLACGNPLGTLVGTDSTSKAYVGVDGCSQCTAPVALTEAGMAAATCTSCDSDKVPNKDGTGCVLCSVGDCKHCVVDDVCGECSDGYSLDSSGASCVSSSSNRSGLSTGAIAGISVAVIAVVGGLVGFLCWWFLCRGKA

SEQ ID NO: 141 - protein, 651 aa, Giardia intestinalis
MLYSDSDSAMWCGGDSDSMRLLFMGGCYNKDAHPGSEICTKAEGGLCTACNTANGLFKNPVTPSEKGSECILCSDTTDRNGVMGVAGCSECSHTGTSGPATCTECQAGFVTKDSACVKCGDGCSACSADTPTQCTACVEGKYLKDGNTCVDAGGCGADKYADKKTWTCKACDPDIAGCTACEYNDATGKPRCTNCGTNKTPRTTLDGTSTCVTKDYAGCQGADNGLFMTEDNVCRLCSDPAASDSEPKNKGIAGCKTCTKQQSQKPECIECLEGYIKEGNGPAATCEACGANCATCSEKADKTKCQTCKTGFFLKVSSTPGECFACDDTNNGGIEGCSQCTMEASTFKCTDCKVNYRKQSGTSPVTCTKVCEDDTACGGTSGACDAMIIDDQGTTKHYCSYCGDSSKYPIDGLCASEAQSNTCNNHVCESCTTGYFLYMGGCYSTQKAPGSFMCKTAGNTGICTEAANNRYFVVPGASNTDQSVLACSNPLGTLTGTGDTAKAYVGVDGCSQCTAPTPLTGAGMAPAVCTACSGTNKPNLAGSGCFACAVEGCSHCNRDNMCEKCDNNKKVSPGRKSCVDGCPSNSTDTDSVCVCNDGYSPDDAGASCVSSGANRSGLSTGAIAGISVAVIAVVGGLVGFLCWWFLCRGKA

SEQ ID NO: 142 - protein, 628 aa, Giardia intestinalis
MLLVVFYFVLSALAGACTVEANTRDCTENKCEMVGETEICTQCKTGGNVPIDGVCKAVAEAANKCTKSDDNPVGAGDTTCGKCVNAYFMYKGGCYLAGAAGPGTGTKMCKQAAGGKCTQAADAKNYFIPPANTDDTHDSVVWCGDEIGVTLSSTQYKGVAKCLVCDAPGGAGAATCTTCEDGYFGATCKKCHESCRTCEAAEENKCKSCTDGYFLGATNGAAGKCLKCNSKTEEGWHGVDNCAKCTSSNTQNTPATCTECVANFYLKPAAGATPSSCVTETGCGDGYFPTIVDEIKKCIACGTAANGGIDDCKKCSLKTTSAKAGIEIVCTECNTKWLSPLGDACLDSCPPGTHADSGNICPLCHSTCAECDGNAEATSCRACYPGFVLSYGSDKVRGTCIQECTGKYAENCEENMCTAVLGGSKYCSKCKAGFVPIDGVCVSTASRAVTGCTPGNGVCIACTDSYFLQSGGCYQSTVFPGNKLCTLASNGKCTACSNGQTADGQGSCPACNAICATCAAGNIDQCQTCFPGYYKSGTKCVKCSITDNGITGVENCISCAPPAGNSGPVTCYMKTDDTNDGGNDNNGGSTNKSGLSTGAIAGISVAVIVVVGGLIGFLCWWFICRGKA

SEQ ID NO: 143 - protein, 56 aa, Giardia intestinalis
MKTDDTNDGGNDNNGGSTNKSGLSTGAIAGISVAVIVVVGGLIGFLCWWFICRGKA

SEQ ID NO: 144 - protein, 721 aa, Giardia intestinalis
MFEKILFTNCILQLAWIIQTVAGACTPGETGPTKCKTCDAIIGTDSYCSECDQAGEGPINGVCTSELSGNTCANKICTQCVKNYFLYKGGCYKFAESPGNIICEDAIDAAGGTDGVCTTCKAANGFFKHPAPAETKQSCIACNETAGVVDSDTTYKGTSNCLKCDPPAAAIGARADKMAVCTLCDQTKYLKESACVEKAGCGANMFGKPSVQDGNKCIACGDSNAGIEGCAECTAPDEPTIKPTCTKCTGNNYLKTTSEGTSCVQKEQCNGAYFPNDSVDGKKQCVSCGDATNKGITDCTACNLLSSPLETVLIKCSACRSGKKPNEDGSACVDAPGPSPEECSIEGCQICSDDKKTCDKCQSNNYLTPTKLCISDCKKLGNYYLATEQTTGSCRECAMVNCKECTENGKCGICNDGFYLLNEECKPCNDSCKTCEGGVESDKCTSCKSGSALIYAGNGNTGTCSLGCIPKSSADPGSCKTCDLAIDGTKYCSVCNVDKEYPQNGACAGIKARASSCQDGNVNNGVCSKCETGFFLMNGGCYEITKYPGKTVCSKTAADGTCETPATGFSLSSNTLKACFEGCAKCATGDDCSECISGYVSGSTPNSCEKCSTGCATCYPTATTCTSCLAGYYQSGPKCIACDKDDSTIKGISNCLNCAPPSSGSGSVLCYLMKGADNNGGSTNKSGLSTGAIAGISVAVIVVVGGLVGFLCWWFVCRGKA

SEQ ID NO: 145 - protein, 205 aa, Giardia intestinalis
MLSVIPLICTIVLAKNMAKATDCNPPIDGCSTCTGTGDGQTCTGCTAGDQKVQPNGKGCIAGCPPNSDDVGGICTCKSTHKPSDNGQTCVPKTDCNPPIDGCSTCTGTGDGQTCTGCTAGDQKVQPNGKGCIAGCPPNSDDVGGICTCKSTHKPSDNGQTCVPSNTNKSSGLSTGAIAGIAVAAVIVVGGLVGFLCWWFLCRGKA

SEQ ID NO: 146 - protein, 674 aa, Giardia intestinalis
MLVGFLLVFTVTQAHRTSVSTDCPIVNCQTCSQDKQTCVACKQGFVPNEGNTECNSAPAECPIVNCQTCSQDKQTCVACKQGFVPNEGNTECNSAPAECPIVNCQTCSQDKQTCVACKQGFVPNEGNTECNSAPAECPIVNCQTCSQDKQTCVACKQGFVPNEGNTECNSAPAECLIVNCQTCSQDKQTCVACKQGFVPNEGNTECNSAPAECPIVNCQTCSQDKQTCVACKQGFVPNEGNTECNSAPAECPIVNCQTCSQDKQTCVACKQGFVPNEGNTECNSAPAECPIVNCQTCSQDKQTCVACKQGFVPNEGNTECNSAPAECLIVNCQTCSQDKQTCVACKQGFVPNEGNTECNSAPAECPIVNCQTCSQDKQTCDACEPGKHLTPTKKACLTDCPAGTYLSGQTCAPCDPSCAECSGAGASRCTACPAGKMLRYADESKLNEGGQCVEQCVEGPECETCGLTIGGTKYCSKCKGNNVPLNGVCTSNAARTQFCTTAADGACTVCAAGYFVQGGGCYEITRQPGKQVCALTDNKGKCQTCTNSLGPDGAGTCPSCDPTCKTCSAANAANTCTTCATGYYKIALEGACTSCENDSNGITGVKGCLNCAPPPSNTGPVLCYLMKDGDSTGGNVNKSGLSTGAIAGISVAVIVIVGGLVGFLCWWFICRGKA

SEQ ID NO: 147 - protein, 99 aa, Giardia intestinalis
MDNKCSACTEGGKRPNTDGSQCIACSIDGCIRCSEENKCGQCGDDYRLEGEACVSTKPSGGSRSGLSTGAIAGISVAVVVVVAGLVGFLCWWFICRGKA

SEQ ID NO: 148 - protein, 344 aa, Giardia intestinalis
MGGPAVKAAAETLGGACTEVTEGSESTEVSCRCVCKPTFYNSSGTCISCTDSCAVCKDGTLTGCQQCSPGKILSFSIVSSESADCVDQCSVSSECAECGITIDGSRYCTRCKDASTYPFNGVCILNTQRDAYCTSKANGVCTTCSSGAFLMNGGCYTTEHYPGSTICGKQSNGKCEKTKEGYGISPDGKLLECDPTCLACTAPGPGRCTRCPSGALLKRASGAATGSCVGLNACVDGYYADGDACLPCATPGCKTCGHASFCTECAGELFVSLDGRSCLGECTGNKVVGEVPGGVRRCWCERGFYSHGPRVARINPPPRSCVKTGTNQARSTSVTGSPSSPQSV

SEQ ID NO: 149 - protein, 216 aa, Giardia intestinalis
MGGCYSTQKAPGSHMCKTAEGGRCTAPSENSRYFLVPGASNTDQSVLACENPLGTVIGAGSTAKAYVGVYGCTACTAPAALEAPGMAPATCTACSGNNKPNLAGSGCFTCTIDGCSHCGAGGKCEACTSKDQRPNTDGTKCIPCSIDGCVRCSEENKCGQCGDDYSLEGDKCVSSGANKSSGLSTGAIAGISVAVVVVVAGLVGFLCWWFICRGKA

SEQ ID NO: 150 - protein, 256 aa, Giardia intestinalis
MHREDLRGPHGLWGTAGSCDAIVIDDQGTTKHYCSYCGDSSQAPIDGLCASEAQKAGNTCANGVCTQCTNNYFLYMGGCYSTQKAPGSFMCKTAGNTGICTEAANNRYFVVPGASNTDQSVLACSNPLGTLVGTDSTAKAYVGVYGCSRCTAPTALTTAGMTAAVCTSCDNSKVPNKDGTGCVTCSDTNCKSCVMDNICGECVDGYSLEGGKCVSSGANRGGLSTGAIAGISVAVVVVVGGLIGFLCWWFICRGKA

SEQ ID NO: 151 - protein, 96 aa, Giardia intestinalis
MTPAVCTSCDSDKKPNKDGSGCVVCSDTNCKSCVVDGVCGECNSGFSLDNGKCVSSGANRSGLSAGAIAGISVAVVAVVGGLVGFLCWWFVCRGKA

SEQ ID NO: 152 - protein, 1615 aa, Giardia intestinalis
MLKVSLMLAVGLAAPCGDTGYECGDHGTCTLIGEVYRCVCAPGWTGYDCSSCSRGFVNLVENCIPPSCIEDGLECGGRGTCLYLKSKNAWECGSCPVGFYQYSGRCVSSYCYGDEEAGGVTTERPCSGQGICIFNGASEADRVRPDVYICSCNLIHTGSQCQNCDPRFGKIDPLLRACVAMSCYDGEDTEPCQGRGECVENIQQHPFTGELTTGYICRCGYPYQLVGTAKCLPLNCVSTQAGVATECGTGGVCESSGSQFSCRCLSGFVQLTDGHCTAPACRQNDGALACSDIGACVSGGEDPTNPNTYYCQCPMSYSSGDYCEVCDNQRGTTINGKCVAKSCVADNTVCSNNGDCVLEGLFAYRCKCHEGYEAHGTNVCAKPGCWDSIVNKTCSGAGQCTSNGCQCNSGFTLRSMRCIPTKLISGSWVCSGNGTATISSSSADASKPENWICQCDGVTKGTLCNECNTERRPPAAYMINDACTAAACVSDSTTSPPTICNGVQGATCSQYGVDADSVFYCKTPDKSQYLVAYNSSLVVHRGCTYPSKTEYPLNLYCGLLDGHTMYIDDPGAPQCLSALTSTCSCEDPFNFVTVEDAIKSELGDVQYRTSCIHKACLNPDLKGTTDETVLQNPDSYCNGLGDCLQDDHGDYTCFCGPGSTYFKGTCVSNACLTQDPETDATVMCGGLGICALDTYGYWGCVCEYPYFGSGSSCYPIGCGYHDPLDRTTVLCGGEGRGTCVANETHPELATCACNRGFTLINSNYCAPSACTAYGADREGVEPSLSYVCSGIGDCFYNPVTGSYECHCGEGYYATGPYCTLAQCIVVIDAGEAIPGLIGNLYLECGFAGAGTCTSDGCTCNSGYVKTASLSMCVRAGCIDENNVYCGGDHHAACVDKGDGTGFSCVCTAQHVNVNGTCVPKKCVTRDVNGNNVVCGGRGQCIQMWTGYMCACDNNTPAVPSGDSYTCPHPDCCGQVGEDMVVCSDQGSCKETTTGGFCVCNNGYSLVGKSQCIVSECVQTDGNGVTSICGGGECIATNDVHSCACANGFSNVDGRCVHSNCIDTYDGEQIECSGFGKCTAVDSSYKCVCNLGYSPGTEPNRCFSVMCLSTIGDKGYECGGHGKCTYSEEQEEFSCTCESGYKNIDDTSAGYSITYFCVTSGCTTTSEAGQTVCNGGGMCDPTSGRCVCNEGHAGDTCADCADGYIRPPEEYIFKHCMKTTCADSTCGGTGMCVPSLLYNQMVCECADHHTPLDGRCVPCAIDNCETCDVSQLGRACSLCQDGTYLSGDQTQCLPCHADCKTCQGPQSTQCLSCVEGKVHSLNGMGASGCKEECRINVDGCKSCGAMISKTKYCSQCQSQTSVPVNGECKSQATRASECSRYSKGACLACADGYFLYEGGCYETSKLPGRDVCSMASSGSCSYCKIGYSNLAGTCTACKNENCASCNIVTTCDECKPGWSLVNGECVSCAAECESCTQGSPSTCKSCKDEYFASFSFSGDASGPCRPCSDTTPMDGIVGVPGCKYCTLPLTNGTNENPVSVICLTTESAGKMMSTGAIAGITIAVLVVVGGSVAGVLVWFFLFRNRKGPMKKSPRRRFHPDETSTSLLSQDYGSSML

SEQ ID NO: 153 - protein, 348 aa, Giardia intestinalis
MKEDKTKCFGSCLALGPGYYNASGTCARCVENCLSCVDGTSCSRCADGYYLEVSGSDSSTGACRPCAAGCSTCNNGSSTGCTTCLLGYYIAAEGKRQPGQCVKCDSDGNGYVGVQHCIVCRSTVGDGGAKNVVCQKCEDGYLKETDQGKTVCEAPPPTCTVELCALCVADDPNRCEHCTAGAYLCPRTAACTKDCASCGGSMYPDEDLGECQPCDIANCRVCATGLKCESCAENAVPISPDVYHTACMGCSDTGGMDGWVGLAGCTTCELTDKGGGSVNCLDPGYYRRGGLGGGAIAAIVIVVLLVLAVAGFLVWWFVFRRGGRPRRGGTKYTSLMRGESYDYRQSLI

SEQ ID NO: 154 - protein, 801 aa, Giardia intestinalis
MLITCKSDANRRRCAFGMCLNLGPAELCLKCTPGLLLIDGACVEQDSHEVGSAGCEVDPDSYACLSCSSSGYHVYSGGCFSAASGVLELVEPSRDSTLTCEEVISFNMFHTAPGKCKQKHCNVDLGGNKYCSRCSVKSEYLVDGKCLSSTDNNACTSQDYPDGTCKLCGNGYFLYKGGCYSITHGAPGNLICKEVDTIPGVCKLCQDGFFRLPEPAANRQSCMLCNDTSEYEYDDLDSYYEVRTFAGVEGCAKCSFKEEVTILLNKPVCEACHPDYYLLSRGDSAMCLSSQECTSSHFRKTVDEVNLCIFCGDASRGGLDGCSRCTYTANTGAITCESCFLYYYKKVDNGVLSCVPLDECTAPYYPKDSEDPGDLWDKQCLLCSDTNNNGIQDCTACTYTSTGLKCTACSGTKRPNAAGSTCYDCNIANCEECSSDTVCSRCAAGYIISSSACVADPDPCSVAGCKTCVSGNRQLCLVCHDGFYKDGTTCRKCAAGCTVCSGAGAQCTSCEQDRFLLRSESSSSGSCVVACGDGHFEDTTLKVCTRCSDAHCKRCAGPGVCTRCQDDMYLKLTSSSIECVSSHHCYTGSFPQENPDTGNKCVPCGDNLVGISNCIECTLDGGLLSCLKCKSGSFLDLFRRTCITQCPQNSSPKEENRAMACMCEDSYAPSNDGTLCEPTKPCPQYQGCAMCDSLDRCVRCVDPLDNIQLDSTTCQRSCPSGAAVRRGKCHCMGGQVPSGNTCVDPPKKSVSKMSTGMIAGISVASVAIVAVIIGCLVWFLLRRKNSGSLNREPSLFRPLSS

SEQ ID NO: 155 - protein, 581 aa, Giardia intestinalis
MTNRSSRAAMLLLVLCFLMSAFTAQRTKQPTSDCGVANCAQCVSGDNTKCETCSPGFDLSNDKTQCNQRPASNCGVANCAQCVSGDNTKCETCSPGFDLSNDKTQCNQRPASNCGVANCAQCVSGDNTKCETCSPGFDLSNDKTQCNQRPASNCGVANCAQCVSGDNTKCETCSPGFDLSNDKTQCNQRPASNCGVANCAQCVSGDNTKCETCSPGFDLDENTKQCNQSPASNCGVANCAQCVSGDNTKCETCSPGFDLDENTKQCNQSPASNCGVANCAQCVSGDNTKCTKCQSNYFLTPEKNACLTSCPAGSYAVGQTCAPCDSSCAECSGAGASKCTACPAGKMLRYADESKLNEGGQCVEQCVEGPECETCGLTIGGTKYCSKCKGSNVPLNGVCTSNAARTLFCTTAANGACTACAAGYFIQEGGCYKTDRLPGKSICTTDNGGKCQTCANGQTPDGGTGVCPLCDSTCKTCAAGQTQQCQTCFSGYYKSGTKCVKCDASDGQITGVTDCVSCAPPSTNQGPVTCYVKMDGSSGGSSTNKSGLSTGAIAGISVAVIVVVGGLVGFLCWWFICRGKA

SEQ ID NO: 156 - protein, 748 aa, Giardia intestinalis
MFQLIPLFVASALMAACQPDGNHTATCAQNKCETVGATEICTQCRAGGVPVDGFCWPPGSPQAAAAGCTEEDGATLDKTATTCGKCGDGYFLFMGGCYKVGQDPGSEICTKASDGVCTTCKTDNGLFKNPATAPKPGSECILCSDIKGADGYTGVENCAQCTKSDSNKGAATCTECQDGYYKDAKGACVQCQGNCATCETSATQCTSCKAGFYLKDGNSCVAEGECTNTVYPDPESGKCKACSTITDCTECSFDKATGKPQCTACGSQKTPRTTLDGTSTCVDKTLDGCKGADGALFMKDDTTCALCGDASPGAGANDKGIAGCKTCTKQQSQKPECTSCLDGYFFEQSSKTCSACASNCATCTSADVSTCTECLPGYFLKTEGETKCAACDSTPDGGREGCSLCSSNGGFKCTECKPNYKKQSNGGAGDDYTCTKTCEDETACGGTAGACDAIVVGNDGSMLSYCSKCVGAGYGPINGKCTNALAGNTCADGVCTRCTNNYFLYMGGCYDVSKAPGNLMCSAAPSGFCTTPVGRYFKIPGDSAAQQSVLACGNPVGATAGDKAYVGVLDCTACAAPQAPAANAMAAAVCSACDKTKKPNKDGSGCTLCAVGGCKSCAIDGMCEVCAEDNKKPNMAGSTCYVCPAQGCSHCSADNKCEACTNKDQRPSLDGTQCIVCDIERCMRCSAEGVCGECEEGYVPRDGMCVSSGTNRSGLSTGAIAGISVAVVVVVGGLVGFLCWWFICRGKA

SEQ ID NO: 157 - protein, 812 aa, Giardia intestinalis
MLSMSRSLSVLLLVCLLAEFFSEEAPIYRNGFGYFCEGKIPNCLPNSCILGVISQFLCTECESGYVPIDGKCVLAGDSKATRSGCAKSQTGGWCTKCGDDHFVFYGGCYNLSQDWTKFICERAEKGICVECAKANGMRPSAVLTNPNTSAPERCISCGDTVGFGGYSGIYGCLVCNSSRIKQEVVPNCYQCSDHKNTCSYDYRCKHITEGASNGLCGYCPETHIWSFYACYARDTPISNSICLPENIMEMSGQALCSRCTNPLEIPLNGLCLSITEFEDICVKDPESGRCTSCKNEGKRQYFLFYGGCYLFKDVSGRIESQICQAMQGNVCTTCNSSTKEVFTKNNGCWRCGDSANGGIEGCQRCEMKDSGLQCLECRDLYLSLDKRSCLASCPKGQKGIQGSSSSIHICTCDDGSYLKDGKCVGCAVENCAECDESSCKRCKYGYTLSGSQCVATKCKDPNCDTCEDRDVCTKCTDDNSLDLHGLCVKDCLGSAGYYKATVGGVSRCVACTLGNCAVCESESKCKTCRDGFYVEGSGGCKPCSSECATCSGPASDDCTSCPVRKRLEYSDGAKGSCVPQCVQDSSCAECGLTVGGTSYCSRCVKSTEYPNNGACTSSSSRAAGIACANVAAGRCALCSSNSFSLNGGCYTSTLLPGKTVCTKASDGWCDSTVAGYGITYNGTLLTCPTNCATCSGGVCSACNSGFYLEKGACKACSKGCATCPHGEACFDCLAGYYFSESTCKACHKVISKCSLCVVPEGAATPICLEYDNTSKKSALSSGAISGIAIGVVLVVGGVAAVLVWFFVFRKKN

SEQ ID NO: 158 - protein, 128 aa, Giardia intestinalis
MLLVLLASCIAVQAAVCAPALIGAGCATCTGENDGQTCLTCNPQENKVQPGGKKCGVGCPANSTPKESVCECNGGYRPNAQGQCEPSNTNKSSGLSTGAIAGIAVAAVIVVGGLVGFLCWWFICRGKA

SEQ ID NO: 159 - protein, 722 aa, Giardia intestinalis
MMTSLHTSLAMILVTVIIKASIVAGCTSDSDCGGVSGSCTISINDLKYCSKCATEKVPINGRCVSANDAQGNVCSAAGCTRCTKGYFLHYGSCFNISTDSAGSLVCDFVDDENEQLVDGYCTQCNQDGYTDNPKKSSTTQSCIACFESDGTSGCNLCTAIPDDGSTGGFVVICHGCADRDKVAIDNKCVPIGGVEDALSGCVHSTSSGSTYCNRCGAGFLQFASTCLLANGNYAPKICEVSNQIHVADTICCKQCKNTGLAIIDGDCSDFNLMCTCSGGRCTQCAEKKFVYHYGGCYHRYSTLARSICSGDVDVGGRCLQCNTSTASGLFTNPTASDMQACVSCSDTARQGIANCVECSYAQSTLTCTKCSDGSVPQNNHCNAVTPPGPPEGDCSILACKTCNTTDTTRCAVCHMRTYLALDNKTCVSNCSTQNSDDNHYYGDSATGACEKCHSSCRACVGPGENQCTDCVPEQYVPGSVGNCIACSSTQSGSTFTGIPNCIRCYKGGYTTTELKCSACTTGMVPNFNQVHCISSTSCSMKNCELCQTDPSTCDRCQENFFLAPDGSCVSDCATLGPYIGNTQTRKCIHCGEGCMSCNSDLYCTSCQSTYAIVNNRYCFKCDSTDSGSLIMGVPNCTKCKAPSTGHGPVHCLEYSTQPQNETGSRSNATGIAVGVTIAILAIAGVIGFLVWWFVCKKKTNKVNMPPKLSSNSSIVSSRIGLM

SEQ ID NO: 160 - protein, 817 aa, Giardia intestinalis
MLGLPALLLLASSCGASTYTYHNNFGVECNKHRDSCAQNRCVFMGWEELCTQCVSGYVPINGKCQLLDDSSTCVPDDTSSPTRCVECKSEQNVFLFYGGCYTIDQSTIGSEICRQATSSRCTECNVSTTEKYVFTNPDTSAAERCILCSDTVGFGGYRGASDCLYCIQPIKGEIGTALCTKCSYTKQNNGIGPVDYQCQAKGLHNCVNGYCTSCYKTHLFYEYGCYSRHSSTGFAICAEANQYELDNVTICTECVNTSHAPKNGGCTLVGESASRSLFSDCTKDASRGLCTDCSSTGKSFLFYGGCYNRDSHVGSKLCLEAAGGVCKQWRSNFNFTFSKAEGGDRYLCGDTSSGVRGCATCGYNNGVTCTRCSTGYLGVDGRSCSEGCSGDTQGVCTKVAEGSESTEVSCRCVCKPTFYNSSGTCTPCTDSCAVCKDGTPTGCQQCSPGKILESLVVADDNAKCVDECAVGDDCAECGITIDGSRYCTRCKDSNMYPLNGVCIPNTQKDAYCTSTANGTCTTCSGAAFLMNGGCYTKAHYPGSTICDKQSGGKCTTTKEGYGISPDGKLLECDPTCLACTAPGPGRCTRCPSDKLLKKASGAATGGCVDPGACVDGYYAYGDACLPCATPGCKTCGHASFCTECAGELFVSLDGQSCLEECTGDKVVGEVSGGVRRCWCERGFLPALDRSGCVLPTECPSGMPSCAACDESGRCLLCATSGHNVQVDQRTCAEGCGARASSNQGVCMCELDAVLTKGICAPVKTLTKKKLVAIAAGTTMAVLVVGVLVGFLCWWFIFRGRRIDASPSTMTLISSKSM

SEQ ID NO: 161 - protein, 181 aa, Giardia intestinalis
MGGCYKVGQEPGSFMCKASSSNGICTEAASNKYFLVPGASNTDQSVLACSNPLGTLTGTGDTAKAYVGVDGCSQCTAPTALTEGGMAAAVCTSCDSDRKPNRDGSGCVLCSVGGCKSCVMDNICGECNSGFSLDNGKCVSSGTNRSGLSTGAIAGISVAVVVVVGGLVGFLCWWFICRGKA

SEQ ID NO: 162 - protein, 693 aa, Giardia intestinalis
MAGAGATAEDPLMFQLIPLFMASALMAPCQPDGNHLTTCAHEKCETVGSAEICTECKVGGVPVDGFCRPFGSIQAAAAGCTKADGAALDKMTATCEKCGDGYFLFMGGCYKTSLWSEVCTAASNGVCTTCNTKNGLFKNPAATVTPGNECILCSDATDRNGVMGVENCLKCTAPGGNTGAAACTACKAGFYGSGPCTKCHDDCATCSGAANNQCTSCKAGKYLKTDTNTCVDAGSCNGNTYADPVTRTCKDSAITDCTTCEYNPATGGPKCTACGNSKKVKTAIDGATTCVTVASECVDENHFKDDGNTMCVLCSDTSGSDPNKGVAQCKTCTKNGANKPECKTCLEGYVLKGSGADAICESCGNNCAVCTAANDISTCTGCLPGYFLKAEGGTKECVPCDDTAKGGREGCSLCSSNGGFKCTDCKANYRKQSNGDAGDDYTCVKTCEDPTVCGGTSGACDAIVIDANGKEHYYCSYCGETNKFPIDGLCTDNKGTNAGCTDHTCSYCAAGFFLYMGGCYKIDTVPGSYMCSKSTTAGVCDTPNANNRFFVVPKAISAEQSVLACGNPLGTIAGGNAYVGVEGCSQCTAPDARADGGMAVATCTACEDGKKPGKSGTGCVACPDANCKSCTMDDVCEECADGFSLDNGKCVSSGTNKSGLSTGAIAGISVAAIVVVGGLVGFLCWWFICRGKA

SEQ ID NO: 163 - protein, 865 aa, Giardia intestinalis
MLCRAAGVALAVVGGPLMGPLKALDRYWAVLSQCTCGSFGSHWMVRRDCNGATRCTSMTSTLRQSQFYSAQSTSFWPCAEIADCRVVFAIDPVSVDSISACGQRVSEGSINCINRRGLTDVPRVCSYQSINRAMFGSFVLAGVLVQIAWAEKVAERAAQCADNTNCAAEACNVLIDGKLYCSKCKTELVGHAPVNGVCADVSSSKEICKINAEGKCTECAGQSFMYKGGCYQTSQAPGSSMCQAADAGKCTTAPESKAYFVVPEVDRKPTGQTVVSCGDATGVTLADKTYKGVDGCTKCEAPAPADASGAKAATCTACQADKYLKTTTDSATSCVTEKECTDAAGFFVDTTGGKKCSKCDPGCKTCKTEAAKCTSCKDDKPYLKKDAGDTGTCVTEADCKNGNTHYADDTEPKTCKTCAEGTSDGCATCEKSADGAVACKTCGNQKKVQPNKKGCIAKCPETVSAEKDGVCECVEGYVPDNAGTGCTKKSDPQCNTPGCKTCSEPKTSKEVCTECEDAKALTPTGQCIDNCGDLGGYYAGTNEGGKKACKKCEVENCLLCNGQGQCETCKDGYYKSGAACAKCDTSCKTCANGNSNGCTSCESSKALSYEGEGTGTCKPGCEPNANNCEKCELTVDGTAYCSKCKDASQFPQNGVCSAAAGKAITCTTQRDGVCNKCANGFLRMNGGCYETTKFPGKSVCKEVLQNGDTCQTLADGYKLDNGALTTCSAGCKTCTSNTVCTECMYGYAKTNNECKVCTTGCATCAGSTSNCDICSTGYYKSGSTCVSCTANTADGTITGVANCANCAPPLNDKGSVLCYLVQSGENTNKSGLSAGAIAGISVAVIIVVGGLVGFLCWWFMCRGKA

SEQ ID NO: 164 - protein, 832 aa, Giardia intestinalis
MRALILLLLHGIFSECTQDSDCGGATGVCNVTIGGKKYCSKCDGARVPVNGDCRLLSLSRSICIVPTGSNPTPGSCSGCIRDFLFYRGGCYRTASLINAICKEKHIVEEGMYCGACAIEGDVPIDGVCVPAGSAAGNTCSKGVCTTCGNGYFLHYGSCYKFDSSPGSIVCPNQSDTTGSVCGSCGSKFLRNPSASSSATSCLACYGLDGTLFCERCRMNVLTSADSKPTLCTQCKIGYVPVDGRCLSNYSALAALAGCSDPRGNGLCDACSSGFMLFYGSCYSVDGPLAQAICAAEDQIYVNGRVLCKRCAQPDHYPLNGVCIGQSSDGTDGHTCSGGSCTACSTKQTADGTPEFFLFYGGCYDITHPIGKSICSAVVGGVCTTCASSDSSSVITITADGQSSKCLACWDDTVGGVANCGGCSLASDDPAKVVCTRCSDSTEPGEDGACPRALPPATPEGCAVQGCQACLKDSATTCDACFEPLIMKEDKTKCFGSCLALGPGYYNASGACARCAENCLSCVDGTSCSRCADGYYLEVSGSDSSTGACRPCAAGCSTCNDGSSTGCTTCLFGYYIATERRGQPGQCVKCDSDGNGYVGVQHCIVCRSTVGDGGAKNVVCQKCKDGYLKETDQGKTVCEAPPPTCTVELCALCVADDPNRCEHCTAGAYLCPRTAACTKDCASCGGSTYPDEDLGECQPCDIANCRVCATGLKCESCAENAVPISPDVYHTACMGCSDTGGMDGWVGLAGCTTCELTDKGGGSVNCLDPGYYRRGGLGGGAIAAIVIVVLLVLAVAGFLVWWFVFRRGGRPKRGAKYTSLMRGESYDYRQSLI

SEQ ID NO: 165 - protein, 167 aa, Giardia intestinalis
MGNGVCTQCEDNYFLKDGGCYQTDRQPGKQVCSSAQGGNGKCQTCANGLAATDGNCAECHPTCATCSTAGAADKCKTCATGYYKENGDDTTDGPCKKCSEKISGCKQCVSSSGSSVICLESEVGTGGSVNKSGLSTGAIAGIAVAVIVVVGGLVGFLCWWFLCRGKA

SEQ ID NO: 166 - protein, 741 aa, Giardia intestinalis
MFGSFIFAGLAIQIAWAEKVAEHVREVQCADNTNCAADACNVLIGDKLYCSQCDAGSVPINGKCVGKDGATDKCKDSSGGNTADQTCGQCAGQTFMYKGGCYEAAQQPGQTMCTQASEGKCTQAAQGYFVPPGADVSHQSVIPCGDATGITLGDKTYTGVAGCTTCDGSALTSQANGVAKCTACGPDAQQTARIVKTDGGATSCVTEQECTGTEGFFVDTTGGKKCSKCAETCKTCKTGAAKCTPCKDDKPYLKKDDESTTGTCVDANGCPATHYVDKEAKECNTCASGGTVDCATCEKGPTGVVCKTCGPNKKIQPNKKGCVESCPLNSNEEKTSGVCECVEGYVPDNAGTGCTKKSDPQCNTPGCKTCSEPKTSKEVCTECEGTKALTPTGQCIDNCGDLGGYYAGTNEGGKKACKKCEVENCLLCNENGQCDTCKDGYYKSGAACAKCDTSCKTCANGNSNGCTSCEPKKALSYEGEGNTGTCKPGCEPNANNCEKCELTVNGTAYCSKCKDAGQFPQNGVCSAAAGKAITCTTQGSGVCNKCANGLLRMNGGCYETTKFPGKSVCLAAAEASDACQTPADGYKLDNGALTTCSAGCKTCTSQDQCDTCKAGYAKTGGNTQKCVPCATGCSECNANDATKCTVCAAGYYLSKEKCIACDKSDGGSITGVANCASCAPPSAGSGSVLCYLIKDGDSTDGSTNKSGLSTGAIAGISVAVIVVVGGLVGFLCWWFICRGKA

SEQ ID NO: 167 - protein, 741 aa, Giardia intestinalis
MFGSFIFAGLAIQIAWAEKVAEHVREVQCADNTNCAADACNVLIGDKLYCSQCDAGSVPINGKCVGKDGATDKCKDSSGGNTADQTCGQCAGQTFMYKGGCYEAAQQPGQTMCTQASEGKCTQAAQGYFVPPGADVSHQSVIPCGDATGITLGDKTYTGVAGCTTCDGSALTSQANGVAKCTACGPDAQQTARIVKTDGGATSCVTEQECTGTEGFFVDTTGGKKCSKCAETCKTCKTGAAKCTSCKDDKPYLKKDDESTTGTCVDANGCPATHYVDKEAKECNTCASGGTVDCATCEKGPTGVVCKTCGPNKKIQPNKKGCVESCPLNSNEEKTSGVCECVEGYVPDNAGTGCTKKSDPQCNTPGCKTCSEPKTSKEVCTECEGTKALTPTGQCIDNCGDLGGYYAGTNEGGKKACKKCEVENCLLCNENGQCDTCKDGYYKSGAACAKCDTSCKTCANGNSNGCTSCEPKKALSYEGEGNTGTCKPGCEPNANNCEKCELTVNGTAYCSKCKDAGQFPQNGVCSAAAGKAITCTTQGSGVCNKCANGLLRMNGGCYETTKFPGKSVCLAAAEASDACQTPADGYKLDNGALTTCSAGCKTCTSQDQCDTCKAGYAKTGGNTQKCVPCATGCSECNANDATKCTVCAAGYYLSKEKCIACDKSDGGSITGVANCASCAPPSAGSGSVLCYLIKDGDSTDGSTNKSGLSTGAIAGISVAVIVVVGGLVGFLCWWFICRGKA

SEQ ID NO: 168 - protein, 229 aa, Giardia intestinalis
MQGGTCGDACTADKNGCKVCGARIGGTDYCSQCSVDNQAPLNGVCTTSNARVAFCTEMNNGACTKCAANYFLKEGGCYETTKQPGKQICTLADSKGECETCANGLQPNNGACPSCHSTCKTCSTADSSDKCTSCAAGYYMVGSAAGPCTSCDSNSGSVKGVTGCMSCAPPSNNQGSVLCYLMNGDSAGGSTNKSGLSTGAIAGIAVAAVIIVGGLVGFLCWWFLCRGKA

SEQ ID NO: 169 - protein, 636 aa, Giardia intestinalis
MFYAFLLIGLTLQLATEECTPVSGGGPETCKTCGATIGGVSYCSQCNDSGSESAPTDGKCTTDNAVCNAKAEGKCTTCTGSSFMYKGGCYSKDTKPGNAACTQAAAGVCTQAAQGYFLPPDADRDNAHQSAIPCGSEEEVPAKNNHKYKGVPHCTQCDTPDVAADANAKAATCTACESGYFVDNSKGKTCTACADNCLTCTDGTVSKCKSCTAETYFLATEGSEGPCISCGDATQGSGAWKGVAGCAKCTKPQSAGPATCTECQADKYLKTESGTASCVSAEECKDGFFPTADAQGKKVCAKCSDTANGGIEDCAKCSLKATSARAGPMVTCSGCETKRLSPLNDACLEECPAGTYPDNRDSTGICASCHNTCASCSTNAETSCTACYPGYVLSRSSGDAGTCIKECTGDFMAHCKADGCSLNVGGSKYCDQCEDGYAPVDGVCTKVASTARDASGCKASGGKCTECGANYALLSGGCYNTNKVPGNSVCTLSVGGKCTMCVASGADPKGQACPTCPDGCLKCTGNVGSQTCSSCLSGYYLSTNKCFRCTAGDGASANAITGVENCISCAPPTGGNGGSVTCYVKNDDSSGSGTGGSTNKSGLSTGAIAGISVAVIVVVGGLVGFLCWWFICRGKA

SEQ ID NO: 170 - protein, 673 aa, Giardia intestinalis
MLLVAFCFALSTLAATCSADTQVGKCKENMCEMAGSTEICTECKDQGNVPIDGICKPQNDNAVTTAGCKKKAGDNVDASSVRCEQCDAANHFLYKGGCYSKDATPGNQMCKTVTTNGICAEAATTKNYFVVPGATKTDQSVVWCGDVEGVTLGDGKKYTGVDGCTTCEKPEQATDAPKAATCNACGGGKIVKTVDGVTSCVEEADCNNGYFVDSRNGKKCSKCASSCKTCENTETQCTSCTEATPYLKKEDDSETGTCVNQGDCPATHYIDEAAKTCTTCTSGGAKDCKTCEKNGDGAVCKECPDSDKTIFGLNKKSCVASCPANSTPKATGQDSQVCECNEGLQPNTESTECRPISNCNTEHCLECTGEGADKEVCTKCLSEYYLTPTSQCVSDCTTLKGYYGDDSGKKTCKKCNDACVECKGEGADKCTACPAGKMLQYTDADTPANGGTCMNQCSVSSTNDGCAECGAQIGGTAYCSKCKNAQQAPLDGNCAANTRTRFCTTVSNGACTQCENNYFLKDGGCYQTNRQPGKQVCTTVQGGKCTKCASGLTADNGDCSNKRCHLSCETCTAANDANACATCSTGYYKPQSAGTKCNPCSEGLAGCRQCTVSSTDAFMCLEMGDGTSDNTGGSTNKSGLSTGAIAGISVAVIVVVGGLVGFLCWWFICRGKA

SEQ ID NO: 171 - protein, 747 aa, Giardia intestinalis
MFCRFVLAGVILQFVWTAQIAEKAGTATCADQTTNCADEACNVLIDGKLYCSQCKADPADRAPVNGVCTDVSSDTAVCKTHAGGKCTGCNGNSFMYKGGCYERAKPPGNAMCQAADAGKCTEAVAGNKYFVPPADTDDAHDSVVSCGDATGVTLTGDKIYTGVAGCATCEKPEQLSASGTKAATCTACQEGKYLKTATDSATSCVTEEECTGTEGFFVKNGGTKTCEACDPGCKTCKTEAAKCTSCKDDKPYLKKDNGSDTGTCVTETECKNQSTHYADDTEPKTCKACAEGTSNGCATCEKGADGAVACKTCENQKKVQPNKKGCVESCPLNSNEEKTSGVCECVEGYVPEEAGTGCMKKSDPPAAPCNTPGCKTCSEPKTSKEVCTECEGTKALTPTGQCIDACGDLGGYYAGTNEGGKKACKKCEVENCLLCNGQGQCETCKDGYYKKETACAKCDTSCKTCANGNSNGCTSCEPKKALSYEGEGNTGTCKPGCEPNANNCEKCELTVDGTAYCSKCKEAGQFPQNGVCSAAAGKAITCTTKGTGVCDKCANGLLRMNGGCYETTKFPGKSVCLAAAEASDACQTPADGYKLNNGALITCSAGCKTCTSQDQCDTCKAGYAKTGGNTKKCVPCATECSECNANDATKCTVCAAGYYPSKEKCIACDKSDGGSITGVANCASCAPPSAGSGSVLCYLMNGESTGGSTNKSGLSTGAIAGISVAAVVIVAGLVGFLCWWFICRGKA

SEQ ID NO: 172 - protein, 99 aa, Giardia intestinalis
MCNAKIAGSNYCSKCITGQAPINGICTSVTRSARDAVGCAPSNGKCTACTGDYFLQFGGCYEKTQFPGKMVCADVDSQRKCNSCLKFVMYILTLLRSWK

SEQ ID NO: 173 - protein, 194 aa, Giardia intestinalis
MGGCYSTQKAPGSFMCKTAGNTGICTEAANNRYFVVPGASNTDQSVLACSNPLGTLTGTGNTAKAYVGVEGCSQCTAPAALSDGGMAPAVCTSCDSSKKPNRDDMCEACSSGKVSPGRKSCVDGCPSNSTDDNSVCVCNDGYSPDDAGASCVSSGANRGGLSTGAIAGISVAVVVVVGGLVGFLCWWFLCRGKA

SEQ ID NO: 174 - protein, 96 aa, Giardia intestinalis
MAPAICTSCDSGKKPNRDGTGCVLCSDTNCKSCVMDGVCGECSDGYSLEGGRCVSSGSNRSGLSTGAIAGISVAVIVVVGGLVGFLCWWFICRGKA

SEQ ID NO: 175 - protein, 825 aa, Giardia intestinalis
MSRSLSVLLLACLPIGFFSEETPLYRNGFGYSCENGMPNCLPNSCIFDLAGGFFCVECGSEHVPINGTCVSTAHEAVSKAGCAKSPMGGWCMKCGDGYFLFYGGCYELTGGWKAGICDRAEGGVCKECGKGSKISIPIVFTNPNTTSPERCIHCGDPVGFGGYSGTIHCQYCKPPKYAWKTEADCFSCSLPQTMCTFDYRCKIVTSGVDTGYCISCPTTHILSANACFSIDSPIGNSICLPKNIIDITDRSLCVQCTNSSEAPLQGNCVAIAEFSDICVKDTKTGRCTACKNKGDTSYYLFYGGCYSANHGSGEQIGTTICQAAENNICTTCNSSINDVFTKNNGCWRCGDSANGGIEGCQRCEMKDSGLQCLECRDLYLSLDKRSCLASCPKGQKGIQGSSSSVHSCACDDGSYLKDGKCVGCTVENCAECDESSCKKCKYGYTLSGSQCVATKCKDPNCDTCENRDVCTKCADDHSLDPHGLCVKDCLGSAGYYKATVGGVSRCVACTLGNCAVCESESKCKACRDGFYVEGSGGCKPCSSECATCSGPASGDCTSCPAKRRLQYSDGAKGSCVPQCVQDSSCAECGLTVGGTSYCSRCVKSTEYPNNGACTSSGSRAVGIACANVAAGRCVACSSNSFSLNGGCYTSTLLPGKTVCTKASDGWCDSTVAGYGITYNGTLLTCPTNCAMCSSGVCSACNSGFYLEKGACKACSKGCATCPHGKACFTCLAGYYFSESTCKACHKAISKCSLCVVPEGAVKPICLEYDNTSKKSALSSGAISGIAIGVVLVVGGVAGVLVWVFVFRKKAGVPPLYKQSIVASTH

SEQ ID NO: 176 - protein, 393 aa, Giardia intestinalis
MLVGFLLVCATVLANCATGQCRAGHVPIDVCPDSSAVYGAGSECTVPNCKRCAQGKPAECEECNSNFNLDSNTKQCNPVSAECTVPNCKACDNPKTDNEVCTECNDGNYLTPTSQCVSDCTAISGYYGDTNERKCKKCNDACAECKGAASNQCSACPAGKKLTYTDDSNPNNGGACGDACKVSADGTGCETCGAQIGGTAYCSKCKTSTQAPLNGNCAANTRTRFCTTVSNGACTQCAANYFLKDGGCYQTDRQPGKQVCSSAQGGTCQTCANGLQAQGGACGECHSTCATCSTADAADKCKTCATGYYKENGDDTTDGLCKKCSEKISGCKQCVSSSGSSVICLESEAGTGGSVNKSGLSTGAIAGISVAVIVVVGGLVGFLCWWFLYRGKA

SEQ ID NO: 177 - protein, 87 aa, Giardia intestinalis
MVGSAAGPCTSCDSNSGSVKGVAGCMSCAPPSNNQGSVLCYLIKDTGSTNRSGLSTGAIVGIFVAVIVVVGGLVGFLCWWFLCRGKA

SEQ ID NO: 178 - protein, 804 aa, Giardia intestinalis
MLGLLPLALLASLCKSSRDVYYNKFGVGCDGKQENCAQDRCILLGSDQLCTQCVPGYVPIDGKCQKYPGASSSPCTPDDPASPTRCIACKQETNIFLFYGSCYTITTAQDRNLGNFLCSEASNGVCTECFESKFERYVFTNPDVGAVEKCILCSDTVGFNGYKGASGCSDCLPPITDKIGIALCVRCHYTTEDRHFYPIDYQCQAKGPHNCVNGYCTSCYKTHLLYKLGCYSRHSSTGLAICVEANQYELDNVTICKECANASYAPRNGACILIKENPSIEEIAFKCTKDPTKGLYTACPASAKSFLFYGGCYDEDAHISSRLCSRIGSNACEQWNSAFKWIFSKNGDNNKNGYLCGDITNGGISGCATCNYASGAVTCTRCSAGYLGVDGKSCSESCSGDTQGACTEIVEKSSSTKILSCRCICRMGLYNSSGTCTPCTDSCAVCKDGTLTGCQQCSPGKILSFSIASSESADCVSQCSVGSECAECGITIDGSRYCTRCKDASTYPFNGVCILNTQRDAYCTSKANGVCTTCSSSAFLMNGGCYTKAHYPGSTICDKQSNGKCTTTKKGYGISPDGKLLECDPTCLACTAPGPGRCTRCPSDKLLKRASGATTGSCVDPGACVDGYYADGDACLPCATPGCKACGHASFCTECAGELFVSLDGQSCLEECTGDKVVGEVPGGVRRCWCERGFLPALDRSECVLPIECPPDMPSCAACNESGNCLSCVTSGHNVQVDQRTCAEGCGARASSNQGVCMCEFDAVLTKDICVSAKELAKKRTAAIAGGTVAGVIVIGSLVGFLCW

SEQ ID NO: 179 - protein, 553 aa, Giardia intestinalis
MKQDPVRLLMQTRAVLCQLLASMLVGIGLIFAVALTEVCSPSIDGCAECDSTGQGCTKCDANGNTPYLKKTNPSDPTGTCVSAVDCQGSAGYYTDDSVSDAKECKKCAEGQKPNTAGTQCFSCSDANCERCDQNDVCARCSTGAPPENGKCPAATPGCHSSCDGCTENAMTNQADKCTGCKEGRYLKPESAAGQSGTCLTAEECTSDTTHFTKEKAGDSKGMCLPCSDATHGIAGCKKCALKTLSGEAESTVVCSECTDKWLTPSGNACLDNCPAGTYPNDNNLCTSCHDTCEECNGNADAASCTACYPGYSLLYGSGTAGTCVKECTGAFGANCADGQCTADVGGAKYCAQCKDGYAPIDGICTAVAAAGRTNVCTAADGKCTKCAGEYTLMSGGCYGVAKLPGKSVCTLASNGKCIMCAANGQAPVQEKCPECSEGCAKCNDSNACTECLPGYYKGAGDKCFKCTASSGNNNQITGVANCVSCAPPAGGSGSVTCYVKTDGTSGGDDNTGGSVNKSGLSTGAIAGIAVAVVVVVGGLVGFLCWWFICRGKA

SEQ ID NO: 180 - protein, 197 aa, Giardia intestinalis
MVSESGILQECSIANCAECTADACVRCKLGYVSVDGQCQKCAQGCVTCIAPDNPQMCTLCDTGYYQSTTGSAFTCTACGADNNGMKGVNGCTCCMPPEGKVGSVLCYSFDALPSIIPTPKPGPDPVPDPVPAPAPSSARKTAMIAGVSVTAILLVTGLVSFLLRWLLCRRTQSHETKRVTLTRKRVPIITSITAPLT

SEQ ID NO: 181 - protein, 832 aa, Giardia intestinalis
MRVLILLLLHGIFSECTQDSDCGGATGVCNVTIGGKKYCSKCDGARVPVNGDCRLLSLSRGICIVPTGSNPTPGSCSGCIRDFLFYRGGCYRTASLINAICKEKHVVEEGMYCGACAIEGDVPIDGVCVPAGSAAGNTCDKGVCTTCTGGYFLHYGSCYKFDSSPGSIVCPNQADTTGSVCGSCGSKFVKNPSASSSATSCLACYGLDGTLFCERCRMNVLTGADVKPTLCTQCKIGYVPVDGRCLSNYSALAALAGCSDPRGNGLCDACSSGFMLFYGSCYSVDGPLAQAICAAEDQIYVNGRVLCKRCAQPDHYPLNGVCIGQSSDGTDGHTCSGGSCTVCSTKQTADNTPEFFLFYSGCYDITHPIGKSICSAVADGACTACASSDSSSVITITADGQSSKCLACWDDTVGGVANCGGCSLASDGPAKVVCTRCSDSTEPGEDGACPRALPPATPEGCAVQGCQACSKDSATTCDACFEPLIMKEDKTKCFGSCLALGPGYYNASGACARCVENCLSCVDGTSCSRCADGYYLEVSGSDSSTGACRPCAAGCSTCNDGSSAGCTTCLLGYYIAAEGKRQPGQCVKCDSSIGGYMGVQHCIVCRSTVGDGGAKNVVCQKCEDGYLKETDQGKTVCEAPPPTCTVELCALCVADDPNRCEHCTAGAYLCPRTATCTKDCASCGGSMYPDEDLGECQPCDIANCRVCATGLKCESCAESAVPISPDVYHTACMGCSDTGGMDGWVGLAGCTTCELTDKGGGSVNCLDPGYYRRGGLGGGAIAAIVIVVLLVLAVAGFLVWWFVFRRGGRPKRGAKYTSLTRGESYDYRQSLI

SEQ ID NO: 182 - protein, 540 aa, Giardia intestinalis
MFYAFLLTGLALELVRAAQAGDECEEVASSEPNTCKACSAVVNGKKYCSQCNGGGSQSAPTDGVCSADNNECTRKQDGKCTQCANKSFMYKGGCYKDSQAPGNTMCETANAGVCTQAKEGYFLPPGTDNAHDSVVSCGDTTGVTLTGDKKYTGVAECVTCTQPGQLSIGGTKAAICTKCAADLYLKIDRGVMECVAESGCGEGFFPTIVDGVKKCAGCSEAGSGGIEDCELCIPRAPAPEAGVKVTCSKCHASKKVSPLKDECMDNCPAGTYDKQNVCTPCHSSCASCQTDDKETSCTACYPGHSLLYEANGATGRCVKECTGAFITNCADGQCTADVGGAKYCAQCKEGYAPIDGVCTAVKIGRDASVCTAASGKCTACTGAYALISGGCYGVAKLPGKAVCTAANNGECTTCANGQQPSGKVCPTCPAGCSKCTGSAPSQQCSECFPGYYKSGTKCVACDKDDGSIKGVPNCLSCKEPASSSGAVTCYVKTDGTNNGGSMNKSGLSTGAIAGISVAVIAVVGGLVGFLCWWFICRGKA

SEQ ID NO: 183 - protein, 529 aa, Giardia intestinalis
MGVEGCATCTAPTNNKGAATCTECQDGYYNDGGACTKCHTDCETCSGAGPNACTSCKAGKFLKTDTNTCVEAGQCGAGKYADKQSGECKACSEITGCTACAYNDQLQKPVCSTCGGAKPLLKGYVDGSTECVDKAGCAALNTVGTHFLSQDENSCILCSATGGTAPDEGIAECSGCKKTDLAQPPICSACLPGFYFDTTCKPCGTNCATCNSANANQCQTCKPGYFLKGGQAPGECVSCDSVDNKGREGCSACSNSGTFKCTDCKPNYRKQPNGDAGNDYTCVKTCEDDTACGGTSGACDAMIIDSTGKELHYCSYCGDNDKYPIDGLCATDKQGNTCDNHVCESCTTGYFMYMGGCYSISAQPGKSMCTKAGEGVCTEAAAGYFIPPSPTKDKQSVLSCGNPLGVELAGQKAYVGVDGCSQCTAPTALTEAGMTAAICTSCDSDKKPNKDGTGCVTCSVGDCKSCVVDDVCGECNSGFSLDNGKCVSSGTNRSGLSTGAVAGISVAVVVVVGGLVGFLCWWFVCRGKA

SEQ ID NO: 184 - protein, 195 aa, Giardia intestinalis
MCVSTTARAAAECVAGEGVCTSCTGAYFLESGGCYKTGAFPGNTLCIAAGANGKCANCANGQNADPQTGACPPCPANCSKCSGDSGVKTCTECYSGYYLDTGKECKKCSETSGNIQGVPNCVSCKAPSSPNAPTPVTCYVKTDGTNNGDNDNNGGSTNKSGLSTGAIAGISVAVVVVVAGLVGFLCWWFICRGKA

SEQ ID NO: 185 - protein, 542 aa, Giardia intestinalis
MQTRAVLCQLLASMLVGIGLIFAVALADACSPSIDGCAECDSTGKKCTKCDPNDPSNKKYLKDGACVTDAECTGAHDHYADSTDPTALVCKACGKNEKPNTAGNACFVCPDPNCRRCNEANKCADCATGKPQADGTCPAATPGCHSSCKECVSGANTSEDDKCLSCSGDNYLKVTNAAARSGVCVSASACTSDKTHFAKEVTDSNGSKKMCLSCSDATHGIADCKKCSSTASSAQTELALVCSDCGIKWLSPLGNACLEKCPAGTYSDRSADGISVCASCHSTCAECNGNAEATSCTACYPGSVLSKGNGGATGTCIPECTGRYAENCEAGQCTAVVGGSKYCSKCKAGFAPVDGVCVPITQRTIAGCNPGQDGTCTSCKDAYFKESGGCYQSTTYPGDKLCTTASQGKCTTCANGQAADNQGSCPACPDGCSKCTAGSSPQQCSECFPGYYLDAGKGCKKCSETSGNIQGIPNCVSCAPPTGGNGGPVTCYIKTDGANNGGSTNKSGLSTGAIAGISVAAIVVVGGLVGFLCWWFICRGKA

SEQ ID NO: 186 - protein, 733 aa, Giardia intestinalis
MLFRPTTRHRLAALMFGRFLLAGAILQLARAACEEDKTSTDGKCKTCGVTIGQDTWCSVCIGENYAPINGTCADITTDSVGSVFCTQKAGGVCTQCAGNSFMFAGGCYSSSEGLPGYNLCLRSAGNGVCAEAAPGYFIPGETAATKPSVISCSDKTGLLITAHTYKGVEFCEECSGSELTSGQDGTAKCTKCGASKYLKDNACVDNAEACGKGYFGKPDAAAGNKCIACTDQSDGGTAGCAECMYDSNTRKAICTKCTTDYLRKKADGTTECVAANECDDTQKGFYKVVDSTNGNKCVSCADGAGLAVGTDGAWKGVDGCAKCIKPADINTPTKCDECKPGYEISTDKTKCTSTAPPDCPIENCKVCSEDKRACEECNSNNYLTPTRMCIDDCKKIGNYYYTSNANNKLICKECAVANCKECENTGTCKTCDDGFYKSSEECKACDSNCKTCNGGTSADCTKCLSGAVLKYGNDGTKGTCGAGCATGTGAGACKTCGLIIDGTSYCSECAVETEYPQGGVCSSTTVRAAATCKAGSVAKGMCNSCTNGFLRMNGGCYETTKFPGKSVCEEAASAGDTCQKEAPGYHLNNNDLVTCSPGCKTCTSNTVCTACMEGYVKTSDSCAKCAAGCATCTGSTTACDTCSTGYYKSGTTCVSCTESNSDKTITGVANCASCAPPLNNKGSVLCYLIKDSGSTNKSGLSAGAIAGISVAVIIVVGGLVGFLCWWFMCRGKA

SEQ ID NO: 187 - protein, 443 aa, Giardia intestinalis
MGGCYDKCPYGNGADTNTCADAPAGPASCNPQSPDATSCAPDSCNVVIEGQTFCSKCTGGKVPVNGECKAKGDAPLCTAGANAQEGTCAACTGAQRLYMGGCYDKCPYGNGADANTCADAPAGCNTPNCKACDNPKTDNEVCTECNDGNYLTPTSQCVSDCTTLKGYYGDDSGKKTCKKCNDACAECKGADANQCTACPAGKMLQYTDENSPSSGTCVDGCKPQSGASGCEICGATIGGTKYCSKCSTSTEVPVNGVCKADNARAPVCSKKDNQGGCATCASGYFRQDNGCYKTDRQPGIQICTLASSAGKCETCANSLQPNDGACPSCHSTCKTCSAADSSDKCTSCAAGYYMVGSAAGPCTSCDSNSGSVKGVAGCLNCAPPSSSTGSVLCYLMNGDSAGGSTNKSGLSTGAIAGISVAVIVVVGGLVGFLCWWFLCRGKA

SEQ ID NO: 188 - protein, 394 aa, Giardia intestinalis
MLVGFLLVCATVLAKDSGKDTCFPGYTLNTDTKQCTKDPEAPCNVEGCETCVEGNAQQCKTCRPGYTINTDTKQCTKDPEAPCNTPNCKTCDNPKTDSEICTECNDGNYLTPTNQCVPDCTTISGYYGDTDKKCKACNPECAECVGPANNQCSSCPAGKKLTYTDDSNPNNGGTCGDACKVSADGTGCETCGAQIGGTAYCSKCKTSTQAPLNGDCAASSRATFCTKMGNGVCTQCEDNYFLKDGGCYQTDRQPGKQVCSSAQGGNGKCQACANGLAATDGNCAECHPTCATCSTAGAADKCKTCATGYYKENGDDTTDGPCKKCSEKISGCKQCVSSSGSSVICLESEVGTGGSVNKSGLSTGAIAGIAVAVIVVVGGLVGFLCWWFLCRGKA

SEQ ID NO: 189 - protein, 720 aa, Giardia intestinalis
MFQLIPLFVASALMAACQQDGNHLTTCAHEKCETVGSTEICTQCKAGGVPVDGFCRPFGSPQAAAAGCTKADGAALDKTATTCEKCGDGYFLFMGGCYKTTDGPGSEICTAASNGVCTTCKADNGLFKNPVTPQKPGSECILCSDTIDRNGVMGVAGCSECSHTGTSGPATCTECQAGFVTKDSACVKCGDGCSACSADTPTQCTACVEGKFLKDGNTCVEATECGADKYADKKTWTCKACDPDIAGCTACEYNDATGKPRCTNCGTNKTPRTTLDGTSTCVTKDYAGCKGADGALFMKEDKTCVLCSTVSAGADPNDQGIAGCKKCTKDSATPPTCSECLDGYYNSATGGSGTATCEACGDNCATCAKDTKDQCMTCKPGFFMKGSGPGTCVPCDDQTDGVPGCATCTFSSSLTCNSCKPNYKQSGTGPFTCTKTCEDPTACGGTSGACDAMIIDDQGTTKHYCSYCGETNKIPIDGKCVDSGSINGNTCAKGVCTQCAQGYFLYMGGCYKVASPPGNLMCTEATTAGVCDTPNANNKYFVVPEAKPTQQSVLACGNPLGTLVGTDSTAKAYVGVDGCSQCTAPTAPSEGGMTAATCTACTNNNKPNLAGSGCFPCTVSGCSHCNRDDMCEACSSGKKVSPGRKSCVDSCPSNSTDDNSVCVCNDGYSPDSSGTSCVSSGANRSGLSTGAIAGIAVAVVVVVGGLVGFLCWWFICRGKA

SEQ ID NO: 190 - protein, 96 aa, Giardia intestinalis
MTPAVCTSCDNSKKPNKDGSGCVLCSDTNCKSCVMDGVCGECNSGFSLDNGKCVSSGANRSGLSTGAIAGISVAVIAVVGGLVGFLCWWFVCRGKA

SEQ ID NO: 191 - protein, 598 aa, Giardia intestinalis
MLYSDSDSDSAMWCGGDSGGVGLFFMGGCYKTESQPGSDICTAASNGVCTTCKADNGLFKNPVTPQKPGSECILCSDTTDRNGVMGVAGCSECSHTGTSGPATCTECQAGFVTKDSACVKCGDGCSACSADTPTQCTACVEGKYLKGGNTCVDAGGCDNGNYADKKTWTCKACSEIQGCTACAYDDATGKPKCTDCGSKTVRDELDGTTTCVDEAECKVGKTHFYDASKCVQCGDNGKGGVQNCKLCTAKGTCEACVDGYKVNGNACEACTGNCAECGTAGQINTCTRCMPGYFLKDGPPKTCVLCDDETSGIPGCAECTGGVGSLKCTECKPNYRPSGEPSDLTCTKTCEDETACGGTSGACDATVIDANGKELHYCSYCGESGKYPIDGKCVDNAQSNTCNNHVCTSCAQGYFLYMGGCYKVDTVPGNYMCKASSKEGICTEAANNRYFVVPGAQTTDQSVLACGNPLGTLVGTQGTAKAYVGVEGCSQCTAPAGLSEGGMTPAVCTSCDNSKKPNKDGSGCVLCSDTNCKSCVMDGVCGECNSGFSLDNGKCVSSGANRSGLSTGAIAGISVAVVVVVGGLVGFLCWWFVCRGKA

SEQ ID NO: 192 - protein, 168 aa, Giardia intestinalis
MCTEATTAGVCTTPNANNRYFLVPGASNTDQSVLACGNPLGTLVGTGNTAKAYVGVDGCSQCTAPTALTTVGMTPAVCTSCDNSKKPNRDGSGCVVCSDTNCKSCVMDGVCGECVDGYNLEGDKCVSSGANRSGLSTGAIAGISVAVIVVIGGLVGFLCWWFVCRGKA

SEQ ID NO: 193 - protein, 183 aa, Giardia intestinalis
MYMGGCYDVSKAPGSHMCKKADNNGICTEAASNRYFVVPGAQTTDQSVLACGNPLGTLVDPQGTAKAYVGIDGCSQCTAPTALTTAGMTPAVCTSCDSDRKPNRDGSGCVLCSVGGCKSCVVDDVCGECVDGYNLEGDKCVSSGANRSGLSTGAIAGISVAVIVVIGGLVGFLCWWFVCRGKA

SEQ ID NO: 194 - protein, 446 aa, Giardia intestinalis
MACSTITDCTACKYNATVSKPQCTNCGSKKVKTAIDGTTTCVDVSSGCQDADHFKADGDAACVLCSDTSGDNENTNKGLEGCSACTKPNNNQPPACTGCLPGYYDSAPGTFKCKACAPNCATCTQIGDDKCLTCKEGFFMKVSGPGECVPCSDTAKDGIDGCATCTFSSSLTCNSCKVNYKQSGTPSTGVTCTRTCEDDTACGGTSGACDAMIIDDKGTTKHYCSYCGETNKIPIDGKCVDSGQKNGNTCDNHICTSCTTGYFLYMGGCYSVSTQPGKSMCKTAANGVCTAVNENNKYFVVPEATNAQQSVLACGNSLGTLVDPQGTAKAYVGVDGCSQCTAPTALTTAGMTVAVCTACDSGKKPNKGGSGCVTCSVGDCKSCVVDNICGECVDGYSLDNGKCVSMSTNRSGLSTGAIAGISVAVIAVVGGLVGFLCWWFVCRGKA

SEQ ID NO: 195 - protein, 183 aa, Giardia intestinalis
MNGCYKVGQEPGSHMCKTAGNTGICTEAANNRYFVVPEATNAQQSVLACGNPLGTLIGTQDNAKAYVGVEGCSQCTAPVALTEAGMAAATCTSCDSDKKPNKDGTGCVLCSVGDCKSCVVDDVCGECVDGYSLDSSGTSCVSMSTNRSGLSTGAIAGISVAVVVVVGGLVGFLCWWFICRGKA

SEQ ID NO: 196 - protein, 183 aa, Giardia intestinalis
MGGCYKIGAEPGNLMCKTAEGGKCTAVNANNRYFVVPEAQATDQSVLACGNPLGTLVGTDSTSKAYVGVDGCSQCTAPVALTEAGMAAATCTSCDSDKVPNKDGTGCVLCSVGDCKSCVVDDVCGECVDGYSLDSSGTSCVSMSTNRSGLSTGAIAGISVAVVVVVGGLVGFLCWWFICRGKA

SEQ ID NO: 197 - protein, 128 aa, Giardia intestinalis
MTPAICTSCDSSKKPNRDGSGCFPCTVSGCSHCDMDNMCEACSSGKKVSPGRKSCVDSCPSNSTDDNSVCVCNDGYSPDSSGTSCVSSGANRSGLSTGAIAGISVAVVVVVGGLVGFLCWWFVCRGKA

SEQ ID NO: 198 - protein, 215 aa, Giardia intestinalis
MGGCYSTQKAPGNYMCKTAGNNGICTEAANNRYFVVPEATNAQQSVLACGNPLGTLTGTGDTAKAYVGVDGCSQCTAPAAPSDGGMTPAVCTSCDNSKKPNLAGSGCFPCAVVGCSHCDMDNKCSACTEGGKRPNKEGTACFECNVEGCAYCSGANKCEECSDGFKLEGDKCVSSGTNRSGLSTGAIAGISVAVVVVVGGLVGFLCWWFLCRGKA

SEQ ID NO: 199 - protein, 98 aa, Giardia intestinalis
MTPAICTSCDSDKKPNKDGTGCVLCSVGDCKSCVVDDVCGECVDGYSLDSSGTSCVSMSTNRSGLSTGAIAGISVAVVVVVGGLVGFLCWWFICRGKA

SEQ ID NO: 200 - protein, 707 aa, Giardia intestinalis
MDTALTAVGPPVRPLAPTGAASAQGPSRGSPSPWSSLWGASWASSAGGSYVEGRRDLGSECCTVIVIVIVLCGVWGDSGGVGLLFMGGCYNKDAHPGSEICTAASNGVCTACNTKNGLFKNPVTPQKPGSECILCWDTVGDGATKGVENCAQCQAPQSAGAATCTACQDGYYKNAQTCEKCDQSCLTCETTETQCTSCKGNTFLKDNACVNSDGCTGNTYADPVTMTCKASAITDCTTCEYNPATGGPKCTACNGAKIVKEEADGTTTCIDAGTCTQSGATGENFLSDGDAECILCSNDSSKTDNNKGSPGCGTCSKNGAKPECKTCLDGYYDSGNGNPAVCVACAGDCGKCGPGGAIDTCEKCKPGFFLKNDGAKKCVPCDDPTDGVPGCATCTFSNSFTCDSCKVNYQKKVGAGGAVTCEKTCEDPTACGGTSGACDAIVIDNTGKELHYCSYCGKDSEFPINGLCVGNEKKEGNNCNSHTCTSCTTGYFLYMGGCYKYDTEPGSLMCKTAEGGKCTVANDGNKYFVVPEAQTTDRSVLACGNPLGTLVGTDSTSKAYVGVLNCSQCTAPAAPSEGGMTAATCTACTNNNKPNLAGSGCFPCTVSGCSHCNRDDMCEACSSGKKVSPGRKSCVDSCPSNSTDTDSVCVCNDGYSPDSSGTSCASSGTNRSGLSTGAIAGISVAVVVVVGGLVGFLCWWFICRGKA

SEQ ID NO: 201 - protein, 91 aa, Giardia intestinalis
MCEACSSGKKVSPGRKSCVDSCPSNSTDTDSVCVCNDGYSPDSSGTSCASSGTNRSGLSTGAIAGIAVAVVVVVGGLVGFLCWWFICRGKA

SEQ ID NO: 202 - protein, 614 aa, Giardia intestinalis
MPRRGGLVNRAVMACVTDAGTMFYAVLLIGLMLEMARAAQAGDECEEVTGSEPNTCKACSAVINGKKYCSQCNSGGSQSAPTDGKCTTDNNECSQKQDGKCTQCANKSFMYKGGCYKDSQAPGNTMCETATDGVCTQAKAGYFLPPDADRDNAHQSVIPCGDDTVVTLGNSKQYKGVPHCTQCEKPTEASDTTTAKAATCTACEDGFFGATCEACQDENCATCAMTGNNKCSKCKGTGTKTYLKVDSGSTGTCVEASGCTAATFPKVDEQQGNKCAACNSVPDGGIANCATCSLLTQGSRAAPLVTCLTCEQNKYLTPEKNACLDTCPAGMYAVSGDSGNVCTPCHESCASCSNDAATSCTACYPGHVLSRSSGDAGTCIKECTGDFMAHCKADGCSLNVGGSKYCDQCEEGYAPVDGVCTSIPATARDASGCKASGGKCTECGANYALLSGGCYNTQKLPGSSVCTAAQNKGQCQTCANGQSPAGGKCPACTEGCVKCAGSKETCTDCLAGYYKGAGDKCFKCTDSDKASSNAITGVENCISCAPPAGGNGPVTCYVTQQKADDGTGGDTGGDSTNKSGLSTGAIAGISVAVVAVVGGLVGFLCWWFLCRGKA

SEQ ID NO: 203 - protein, 128 aa, Giardia intestinalis
MTAATCTACTNNNKPNLAGSGCFPCTVSGCSHCNRDDMCEACSSGKKVSPGRKSCVDSCPSNSTDTDSVCVCNDGYSPDSSGTSCASSGTNRSGLSTGAIAGISVAVVVVVGGLVGFLCWWFVCRGKA

SEQ ID NO: 204 - protein, 91 aa, Giardia intestinalis
MCEACSSGKKVSPGRKSCVDSCPSNSTDDNSVCVCNDGYSPDSSGTSCVSSGANRSGLSTGAIAGIAVAVVVVVGGLVGFLCWWFICRGKA

SEQ ID NO: 205 - protein, 229 aa, Giardia intestinalis
MQGGTCGDACTADKNGCKVCGARIGGTDYCSQCSVDNQAPLNGVCTTSNARVAFCTEMNNGACTKCAANYFLKEGGCYETTKQPGKQICTLADSKGECETCANGLQPNNGACPSCHSTCKTCSTADSSDKCTSCAAGYYMVGSAAGPCTSCDSNSGSVKGVAGCMSCAPPSNNQGSVLCYLMNGDSAGGSTNKSGLSTGAIAGIAVAAVIIVGGLVGFLCWWFLCRGKA

SEQ ID NO: 206 - protein, 645 aa, Giardia intestinalis
MLYSDSDSAMWCGGDSDSMRLLFMGGCYNKDAHPGSEICTKAEGGLCTACNTANGLFKNPVTPSEKGSECILCSDTIDRNGVMGVAGCSECSHTGTSGPATCTVCQDGYIKKGDACEKCDQSCLTCDGSGPNHCTSCPEGKYLKTDKSCVNNNGCTGNTYADPESGKCLPCNTIDQACTQCEVDSTTKKPKCTNCGGQKMVKTAIDGTTTCVDANGCATSNVDGSHFLNDGSTKCILCSDDSESLEANKGTPGCKTCKKNGAKPTCSECLDGYYNSGNGGTVTCEACGANCATCTQAGNDKCTKCKPGFFMKQPGSTGECVACDSTTDGGREGCSLCSNNNGFKCTECKPNYRKQSNGDAGDDYTCVKTCEDDTACGGTSGACDAIVIDDKGVEHHYCSYCGEANTYPIDGKCNSAKANNQCDQGVCTQCTNNYFLYMGGCYSTQSPPGNYMCKTAGNNGICTEAANNKYFVVPGATNQNQSVLACGNPLGTLVDTKAYVGVDGCSACTAPAAPSDGGMTAAVCTSCDSSKKPNRDGSGCFACAIEGCSHCNRDDMCEACSSGKVSPGRKSCVDGCPSNSTDDNSVCVCNDGYSPDDAGASCVSSGSNRSGLRTGAIAGIAVAVVAVVGGLVGFLCWWFLCRGKA

SEQ ID NO: 207 - protein, 169 aa, Giardia intestinalis
MCKTAGNTGICTEAANNRYFVVPEATNAQQSVLACGNPLGTLIGTQDNAKAYVGVLNCSACTAPTALSDGGMTAATCTSCDSDKKPNKDGTGCVLCSVGDCKSCVVDDVCGECNSGFSLDSSGTSCVSMSTNRSGLSTGAIAGISVAVVAVVGGLVGFLCWWFVCRGKA

SEQ ID NO: 208 - protein, 280 aa, Giardia intestinalis
MEASTFKCTDCKVNYRKQSGTSPVTCTKVCEDDTACGGTSGACDAMIIDDQGTTKHYCSYCGDSSKYPIDGLCASEAQSNTCNNHVCESCTTGYFLYMGGCYSTQSPPGQHMCKTAANGVCTAVNENNKYFLVPGASNAQQSVLACSNPLGTLVDPQGTAKAYVGVHGCSQCTAPAALTTVGMAAAVCTACDSGKVPNKDGSGCVTCSVGDCKSCVVDDVCEECNSGFSLDSSGASCVSSGANRSGLSTGAIAGISVAVVAVVGGLVGFLCWWFVCRGKA

SEQ ID NO: 209 - protein, 188 aa, Giardia intestinalis
MNGGCYETTKFPGKSVCEGANADADTCKAPVPGYKVEAGKLVMCSKGCDTCSDATTCTKCGDGYTKIENSQTCTKCDSSCETCTGAATTCKVCATGYYKTALGESTCTSCENDSNGVIGVKGCLNCAPPSSSTGSVLCYLMKGENTGGSVNKSGLSTGAIAGISVAAVVVVAGLVGFLCWWFICRGKA

SEQ ID NO: 210 - protein, 96 aa, Giardia intestinalis
MTAAICTSCDSDKKPNKDGTGCVTCSVGDCKSCVVDDVCGECNSGFSLDNGKCVSSGANRGGLSTGAIAGISVAVVVVVGGLVGFLCWWFVCRGKA

SEQ ID NO: 211 - protein, 90 aa, Giardia intestinalis
MVGSAAGPCTSCDSNSGSVKGVAGCMSCAPPSSSTGSVLCYLMNGDSAGGSTNKSGLSTGAIAGISVAVIVVVGGLVGFLCWWFLCRGKA

SEQ ID NO: 212 - protein, 55 aa, Giardia intestinalis
MCFVMGDGTGDNTGGSVNKSGLSTGAIAGISVAVIAVVGGLVGFLCWWFVCRGKA

SEQ ID NO: 213 - protein, 181 aa, Giardia intestinalis
MGGCYDASKAPGSHICKTAEGGKCTAVNDGNRYFVVPGAQTTDQSVLACGNPLGTLVDPQGTAKAYVGIDGCSQCTAPAGLSEGGMTPAVCTSCDNSKKPNKDGSGCVLCSDTNCKSCVMDGVCGECNSGFSLDNGKCVSSGANRSGLSTGAIAGISVAVVVVVGGLVGFLCWWFVCRGKA

SEQ ID NO: 214 - protein, 130 aa, Giardia intestinalis
MAPATCTACSGNNKPNLAGSGCFACTVSGCSHCGAGDKCEGCTSKDQRPSLDGSQCIACSIDGCVRCSEENKCGQCSDGYRLEGGRCVSSGANRSGLSAGAIAGISVAVVAVVGGLVGFLCWWFVCRGKA

SEQ ID NO: 215 - protein, 236 aa, Giardia intestinalis
MLQYTDADTPANGGTCMNQCSVSSTNDGCAECGAQIGGTAYCSKCKNTQQAPLDGNCAANTRTRFCTTVSNGACTQCENNYFLKDGGCYQTDRQPGKQVCTTVQGGKCTKCASGLTADNGDCSNKRCHLSCETCTAANDANACATCSTGYYKPQSAGTKCNPCSEGLAGCRQCTVSSTGAFMCFVMGDGTGDNTGGSVNKSGLSTGAIAGISVAVVVVVGGLVGFLCWWFICRGKA

SEQ ID NO: 216 - protein, 96 aa, Giardia intestinalis
MAAAVCTSCDSDRKPNRDGSGCVLCSVGGCKSCVVDGVCGECNSGFSLDNGKCVSSGANRSGLSAGAIAGISVAVVAVVGGLVGFLCWWFVCRGKA

SEQ ID NO: 217 - protein, 127 aa, Giardia intestinalis
MCEVCAEDNKKPNMAGSTCYVCPAQGCSHCSADNKCEACTNKDQRPSLDGTQCIVCDIERCMRCSAEGVCGECEEGYVPRDGMCVSSGTNRSGLSTGAVAGISVAVVVVVGGLVGFLCWWFVCRGKA

SEQ ID NO: 218 - protein, 228 aa, Giardia intestinalis
MFAGLIFASLVLQLAAATRPAERSRSDTPCTESGNDTCQTCSGSGSNEICLTCKNNDHFLTTNKKGCKAACDATGEIETPGANPKACKCDDASGYQLQGDGTCAKGQDTPCTESGNDTCQTCSGSGSNEICLTCKNNDHFLTTNKKGCKAACDATGEIETPGANPKACKCDDASGYQLQGDGTCAVSNTNKSSGLSTGAIAGIAVAAVIVVGGLVGFLCWWFLCRGKA

SEQ ID NO: 219 - protein, 258 aa, Giardia intestinalis
MLSYCSKCVGAGYGPINGKCTNALAGNTCADGVCTRCTNNYFLYMGGCYKATEVPGSLMCSEATTAGVCTTPNANDRYFVVPEAKATDQSVLACGNPLGTLVDPQGTAKAYVGVDGCSQCTAPTALTEGGMAAAVCTSCDSDRKPNRDGSGCFSCAISGCSHCNRDDMCEVCSSGKKVSPGRKSCVDGCPSNSTDDNSVCVCNSGYSPDSSGTSCVSTSTNRSGLSTGAIAGISVAVVAVVGGLVGFLCWWFVCRGKA

SEQ ID NO: 220 - protein, 98 aa, Giardia intestinalis
MAAAVCTACDSGKVPNKDGSGCVTCSVGDCKSCVVDDVCEECNSGFSLDSSGASCVSSGANRSGLSTGAIAGISVAVVAVVGGLVGFLCWWFVCRGKA

SEQ ID NO: 221 - protein, 127 aa, Giardia intestinalis
MCEVCAEDNKKPNMAGSTCYVCPAQGCSHCSADNKCEACTNKDQRPSLDGTQCIVCDIERCMRCSAEGVCGECEEGYVPRDGMCVSSGTNRSGLSTGAVAGISVAVIAVVGGLVGFLCWWFVCRGKA

SEQ ID NO: 222 - protein, 183 aa, Giardia intestinalis
MGGCYSTQSPPGQHMCKTAANGVCTAVNENNKYFLVPGASNAQQSVLACSNPLGTLVDPQGTAKAYVGVHGCSQCTAPAALTTVGMAAAVCTACDSGKVPNKDGSGCVTCSVGDCKSCVVDDVCEECNSGFSLDSSGASCVSSGANRSGLSTGAIAGISVAVVAVVGGLVGFLCWWFVCRGKA

SEQ ID NO: 223 - protein, 156 aa, Entamoeba dispar
MLFTLLIPLIVAQNPECSSAYCSSCKTNPNVCDSCAPNYILIDGTCKYFKEVVPYCAISSENGCSSCMLGYYLKDGKCQIPPNPLCATYKGDKCIVCVDGYYAKAGECFECVENCYECSSMTQCFECLDGYGFNGDDCVQSLDHCKTYSYGSSTKM

SEQ ID NO: 224 - protein, 461 aa, Entamoeba dispar
MLFTLLIPLIVAQNPECSSAYCSSCKTNPNVCDSCAPNYILIDGTCKYFKEVVPYCAISSENGCSSCMLGYYLKDGKCQIPPNPLCATYKGDKCVVCVDGYYAKAGECFECVENCYECSSMTQCFECLDGYGFNGDDCVQSLDHCKTYSYGSSTRCSECYDGYGLNKKNQCEKCAIDGCYSCSLDYTKCDICYNTKHFDGKACVDFIPVEHCTSYTDSLDCSSCEDGYYLDEGKCKACKVELCNKCNSPYTCNKCQEGYYWNEKECTSCPVIPIGCIGCSGINKCSVCKEGYHLVGSYCYENVEHCVVYSYEQCKTCEEGYYLSKGKCLKGVEHCRSHSSDGKKCIECGKGYYLTEDFKCSKCDSTCNECEHKATYCELDSLNENKEDVHPIRMAHCNRASADGQRCMRCDDNTYLKDGKCVECGDDKCYGCTEDNKCSVCAKTQEDFFNGIVYLPNNNHC

SEQ ID NO: 225 - protein, 157 aa, Entamoeba histolytica
MIFTLLIPLIVAQNPECSSAYCSSCKTNPNVCDLCAQNYILVDGKCKYFKEVVPYCAISAKDGCSACMSGYYLKDGKCQIPPNSLCASYKGGKCIVCVDGYYAKAGECFECVDHCYECSSMTQCFECLDGYGFNGDECVQSLDHCKAYSYGSSTRCR

SEQ ID NO: 226 - protein, 1336 aa, Entamoeba histolytica
  misc_feature (380)..(413): Xaa can be any naturally occurring amino acid
MKSTLWLIVLFSLHVYSQCYDECPYCLWGLCHACTKGCSYGSWRDNAFCSYCYRLLTVIECKRGCEACDEEYHCTKCNLGYWLRKYSSKVSLCEKCPTACLECSSPTQCSSCSKGYYLDNGMCYQCPIGCSLCSGPDSCITCERNYGVVVYGDSSWCSPCTTIRCSSCQVGTYLSNGLCSACPNECTTCNTFNECTGCKDGYYLENGKCVLCSNKLKGCTSCDITGSVCYECTTRYRLSQGLCIGCPTERGEGVDMCNNKGWQTICQYGYIDPYGGCEKCNGGDACLTCTYKENRCQSCKDGYYLNRNKCDKCDVLGCAWCQDDHTSCKRCKEGYLLKNGECVSCTELPECEYCSNECKRCSKGYAFDSQHTCTKCSNCXXXXXXXXXXXXXXXXXXXXXXXXXXXXXXXXXXKIEEESNGICLLCSIKNCKVCDCNLKTCIVCEDGYVYDSYTKQCTVKPGDLCEVYKTSSCIKCRDGYAVDYINNKCIKCGNNCKTCRYTNGHFKCLSCDSSLNLYLLNSQCVSPTNEKCNVVGFDSCRSCINNTKVVDGECKECSGHCLRCSQDECLQCDTSTILQNGKCAENLDCLITNEYGSCSKCVSTKVLNSETSLCESCPENCKECLSSTNCHECMNGYVLYNQTNCIKLANTKLRLKRLTNSLIHHCEKETTVGCQRCDSGYYLTDILMCDPCIENCEQCNNPTTCQKCSSGYILNNSVCVKQGRKGCKVITQNGERCAICEDGYFYKDGSCEKCDSSCLTCSKKSLFCLQCAENFYFVSSNTCYNYSTIEYCLAANDNGCTLCENGTYLTNYDSLNKAYLPYHHCLHCHEYCLECEQGSGICIQCDYTHALVSGKCVNASGIPHCTTIKNSICVSCEGGYQVDEDGLVCLEKSKSVVPIAVSLVSLGVIVGALLLFIIIIFMVFLRRRKIQQEKEMRVFLMKRSNVMFKQVPNSPICISKTVLHFDETKIEIPVNKESKDLICIGNLDKRKLKIQMTSVESCKYEIRTDPSVVELKHGEACEFQIFITPYCTCSINNSIKLVYLDYKEGIQKDIDIGINTQTEMSPFIDADELKEDKFLGEGSFGMVYKGVYRNITVAIKKMKTNDIDEMEKELEMLNKVKSQCIIRFYGCVQTNGNVSLVMELAEFGSFSDVIQKKNLKMNLRVYLDAAKGVEYLHNNGIIHRDIKPDNVLIVNNNIDADICGKLTDFGSARMINIIRKNRTFTSGIGTPIYMAPEILNGEHYEAPVDIFSMGVMLYEACSFIKPYSNKVLFPNSWSVPMFVQSGKRLPQVEPIQDDCFNVIQKCWEANIDLRPDASHLVLLAKALYQHYSSLAN

SEQ ID NO: 227 - protein, 461 aa, Entamoeba histolytica
MIFTLLIPLIVAQNPECSSAYCSSCKTNPNVCDLCAQNYILVDGKCKYFKEVVPYCAISAKDGCSACMSGYYLKDGKCQIPPNSLCASYKGGKCIVCVDGYYAKAGECFECVDHCYECSSMTQCFECLDGYGFNGDECVQSLDHCKAYSYGSSTRCRECYDGYGLNKKNQCEKCAIDGCYSCSLDYTKCDICYDTKHFDGKACVDFVPIEHCASYTDSLDCSYCADGYYLDEGKCKACKVELCDQCKSPYTCNKCQEGYYWNEKECTSCPAIPIGCVGCSGINKCSVCKEGYHLVGSYCYENVEHCAVYSYEQCKTCEEGYYLSKDKCLKGVEHCKRHSTDGKKCVECGKGYYLTEDFKCSKCDSKCNECEHKSTYCELDSLDENKEDVHPIRMAHCTRASADGQRCMSCDDRTYLKDGKCVECGDEKCYGCTEDNKCSVCAKTQEDFFNGIVYLPNNNHC

SEQ ID NO: 228 - protein, 407 aa, Giardia intestinalis
MFCKLFWINCLLQLAWAACLEQGNGSGRCKAGMCNVQLGEGDDGKYCSECHATGDFIINGVCLQANDNSACKANADKGICDSCAAGYFLYKGGCYKFGELPGKLICNDVAAAPGGRAAVVGVCSECNTAGGFFKHPDAVATKQSCILCNETENISNVKGVVGCSACTPPKTAESLTPATCTKCASPKYLKADGTECLTDATKCTTPAEFGKADSSAGNKCVSCGDEAAGVAGCAECTAPTEPTNKPTCTKCSGDNYLKTVDGTTTCVTKGDCNGGYFPNDSVDSKKQCILCGTVANNGIDGCTECALLSSPSRAVLITCSACVSGKKPNTDGSQCIACDIDGCTRCSEENKCSQCGDGYRLEGGTCVRTGGGNLSTGAIAGISVAAVVVVGGLVGFLCWWFVCRGKA

SEQ ID NO: 229 - protein, 596 aa, Giardia intestinalis
MCGLAVQSNCSQCVTPAEYLINGACSTANTNDACASGQPTDGTCKSCKTGYFLYEGGCYAQSSPPGNIICQAAGDTAGVCGECKVANGFFKNPDTAAKQSCIACNRTEPMGLVVGVADCSLCTAPSVEGATSPKAVVCTKCDTTATKYLKKADDGTTTCVAENQCDVSGTAYYKVSDATKGNKCISCSDAAGITDAAGETWKGVTGCAKCTKPGSAGAAICTECQADKYLKAGDTPSCVRGADCNTEFFPVVDESENNKKVCVSCGTGNKGGITNCKTCSPKTSAAKEGAKITCTECTANNLSPLKDECMATCPAGTYVKNKVCAPCHASCASCQADDTETSCTACYPGYSLLYGTDGSSATGRCVKECTGEFGVHCITGQCDGVVGGSRYCKKCEHGYVPIDGVCTATGAVRSTSMCTAGEGVCTGCTGDYALLSSGCYNTKKLPGSSVCTAASNGACTTCAANSKAPAGGSSCPTCPDGCAKCSDSSACSECLPGYYKGTGNKCFKCTEGDNASSNAITGVESCVSCAPPSGGAGGPVTCYIKADNNSDGSGGDTTNKGGLPTGAIAGISVAVIAVVGGLVGFLCWWFVCRGKA

SEQ ID NO: 230 - protein, 820 aa, Giardia intestinalis
MFSFPLLVLVTSSCGSVANRYYNRFGVACEKDNDNCAQDRCILVGLVSACTQCNPGFVPINGTCTAYPTDASSICIPDNASSPTRCTECKSETNIFLFYGGCYTIITSPEGNVGNYICSQASDGKCTECNTTGLGKYVFTNPDGMADERCILCSDTVGFGGYKGAFGCLDCIQPVNNKVGIALCFTCNTVEFAPIDYQCQPKGAHNCINGYCVSCYKTHLLYKSGCYSRHSATGLAICAESNQYELDNITICKECADSSYAPKSGVCSSTKNSAFPACTKDANRGLCTGCSSSASAFLFYGGCYDRSSRIGSRLCSQITSGTCSQWNDNFKFIFAKGGASDTNRYLCGSAADSGVSGCATCSYEGGAVKCTRCAAGYLGVDGTSCSNSCIGNTLGECSDITEQGGSSPVASCKCVCKPGLYNNSGTCAPCTESCAVCKNGDPNGCQQCNPGKVLESLVVTSDSARCVAECTVGSECAECGITIEGSRYCTRCKDSGMYPLNGVCITDSAQRDAYCTSRASGACNTCSSAAFLMNGGCYKSDYYPGSAVCNAQSGGKCTQAKEGYGMSADGKLQPCGPACLRCTAPGPGLCTECLPGKYMKRVPGAAAGSCIDPDACVNGYYISGNACLPCAVVGCKVCGHVDFCQECAGELFVSLDGRSCQEECGGDHVLGDVSDGVRRCWCERGFLPALDKSRCVEAVECPAGMEWCAMCDASGACLSCAIAGHNIQADLRTCGPGCGDHASPNQGTCVCEVDAVFEGGVCVPASTPTRRKTAAIAAGATVGVLVIGALIGFLCWWFLCKTKHAGVSSNTTTLIRSKSA

SEQ ID NO: 231 - protein, 125 aa, Giardia intestinalis
MCMGGYFKTSSNTCTKCDKSCATCTTAVSTCDICADGYYKSSDKCIACDKGDASITGVRNCVDCAPPASKTGPVLCYLMKGDVIDPGKKSSLSGGAIAGIIIAVILVVGGLAGFLCWWFICRGKA

SEQ ID NO: 232 - protein, 470 aa, Giardia intestinalis
MILAWMTLAGALASCREGILDGDCFLLSCDVILDQVYCSVCTAMTEFLIDGQCLPNNVDNTCRHSFGNGTCDSCAGPYLSYRGGCYRVGEEPGNFICKPEDVFYVDGTALCRKCVVYGEFPIDGSCTKKAHGNRCGTKGYEGTCESCGTGYFYHNGGCYLKNRFPGNKICADSSAIEHVGHCGTCLDGYETYKGECLACEDANCRKCGISMSDCEICHDGYYLDRDANEGKGVCVPCSPANNCETCIADGECISCVRGFFAGFMGPSGQCFSCDKGGDGYTGVPHCQTCLPPHPNTPDLAAFCTECADGFYLLVSDDRTQTRCVASCPKDKVRYSNRCVTELQGCHNYGRNDECVKCVSGYRLVDGICERCEVDNCEACASSSSVCDTCEAGYGLEDGACNPCGKGCRTCNGDTSVCTMCLVRWEYISPGRNCCISTCPEHSSDVYDGELGSCECHSNYKPSDDGLRCEQ

SEQ ID NO: 233 - protein, 131 aa, Giardia intestinalis
MRVTTTPAPGPARTTRPAGACDAIVIGASGEMTYYCSLCGDSTKIPIDGKCVPSSSANGNTCENGVCKSCTANYFLYMGGCYKVDTTPGNLMCSKATTAGVCDTLNANSRYFAVPGQQTMTRTCRSPLSVL

SEQ ID NO: 234 - protein, 842 aa, Giardia intestinalis
  misc_feature (448)..(448): Xaa can be any naturally occurring amino acid
  misc_feature (528)..(528): Xaa can be any naturally occurring amino acid
MFTYLGILWANIVVGSVEQYYFMFSFPLLVLVTSSCGSVANRYYNRFGVACEKDNDNCAQDRCILVGLVSACTQCNPGFVPINGTCTAYPTDASSICIPDNASSPTRCTECKSETNIFLFYGGCYTIITSPEGNVGNYICSQASDGKCTECNTTGLGKYVFTNPDGMADERCILCSDTVGFGGYKGAFGCLDCIQPVNNKVGIALCFTCNTVEFAPIDYQCQPKGAHNCINGYCVSCYKTHLLYKSGCYSRHSATGLAICAESNQYELDNITICKECADSSYAPKSGVCSSTKNSAFPACTKDANRGLCTGCSSSASAFLFYGGCYDRSSRIGSRLCSQITSGTCSQWNDNFKFIFAKGGTSDTNRYLCGSAADSGVSGCATCNYEGGTVRCTRCAVGYLGVDGTSCSNSCIGNTLGECSDITEQGGSSPVVSCKCVCKPGLYNNSGXCAPCTESCAVCKNGNPTGCQQCNPGKVLESLVVTSDSARCITECTVGSECAECGITIEGSRYCTRCKDSGMYPLNGVCIXDSAQRDAYCTNRASGACNTCSSAAFLMNGGCYKSDYYPGSAVCNAQSGGKCTQAKEGYGMSADGKLQPCGPACLRCTAPGPGLCTECLPGKYMKRVPGAAAGSCIDPDACVNGYYISGNACLPCAVVGCKACGNANVCQECAGELFVSLDGRSCQEECGGDHVLGDVSDGVRRCWCERGFLPALDKSRCVEAVECPAGMEWCAMCDASGACLSCAIAGHNIQADLRTCGPGCGDHASPNQGTCVCEVDAVFEGGVCVPASTPTRRKTAAIAAGATVGVLVIGGLVGFLCWWFLCKTKRGGVSSNTTTLIRPTSS

SEQ ID NO: 235 - protein, 1622 aa, Giardia intestinalis
MTSLLFVLTASLAALCGNTGYDCGTHGTCTLVGEVYRCVCAPGWTGYDCSRCSRGFASLGENCVSPNCIEDGIECGGRGTCLYVRSKDTWECGSCPTGFYQYSGRCVSSYCYHDEEASGVTTDAPCNGRGVCTFEGSLEADRVKPNMYVCSCDMIHTGSQCQNCDPMYGMIDPMLRTCVAKSCYDRDDTEPCQGRGECVMNVQLHPLTGEYTTGYICRCGYPYMLVGTAKCLPINCVSEQAGVATECGTGGICEQSDSGQFSCRCLTGFVQLTDGHCTAPTCRQSESSLACSDIGACVSGGEDPTEASTYYCQCPMSYSSGDYCETCDNQRGVTVNGKCVPKSCVIDNTVCSGNGDCVAEGLFAFKCKCHEGYEAHGTNVCAKPGCWDPIVNKTCSGAGQCTDNGCQCNSGFTWRSSRCIPTTLISGAWVCSGNGTATLSSSSANASDPSSWTCDCDLVTKGNLCTECNSERRPYAAYMINGACTAAACVSDTTASTPVVCNGVDGATCAQYGVDGDSIFYCKTPSRSQYLVAFNTSFVVHRGCTYPSKTKYPLNLYCGLLDGYTMDVYEDGAPQCLSALTSSCSCPDSFNFVSVEDTIQSELGETQYRTSCIHKNCLNPDLKGTTDESVLQNPDSYCNGLGDCLMDEYGDYMCFCEAGSTYFKNTCVSNTCLTQDSETGATTVCGGLGTCALDSYGHWGCVCEYPYFGSGSSCYPIGCGYYDPLTRVTLLCGGEGRGTCTTNAIHPELASCSCNRGFTLIGSNYCAPSACTAYGADKEGVEPNLSYVCSGVGECYLDPLTWNYACHCGEGYYATGPYCTLAQCIVVIDAGGAIPGLVGDLWLECGFAGAGTCSTDGCTCNDGYIKTMLHPMCVHAGCVDENNVYCGGDHHAACIDKGDGTGFTCTCTTQYTNVNGTCAPKQCVTKDINGNNVVCGGRGTCISLWTSHTCSCDNGGPAVQSGDSITCPHPDCYASVGDELVVCSEQGNCKETATGGVCVCNNGYSLVGSSQCIISECVQKDGNGMSSICAGGQCVSTNGVDSCVCADGFSKVDGRCVHRDCIDTLDGEQIECSGFGKCTAVGSSYKCVCNSGYSSGSAPNKCFSFACLSSINGQNYECGGHGKCTYSEETSAFICVCDDGYTTVTGNFATQFCVASGCLTTSDATQTVCNGGGSCDPTNGRCVCDEGFSGDTCASCAEGYIRPPEEYLFNHCMKTACADSTCGGTGVCAPSLLYNQMVCECAEHHTAVNGRCVPCAIDNCETCDISQLGRICYMCKEGTYLSNDQTQCLPCHADCKTCSGPQSTQCLSCVEGKVHSLNGMGASSCKDECKTNVDGCRSCGAVISKTKYCSQCQSQTSVPVNGECKSQTTRSIKTQAAESAECARYSNGVCLACADGYFLHDGGCYETTKLPGRDVCSSATNGTCSYCRTGYSELNGECVACKDENCATCRSPGTCSVCKAGWSLSGDNCVSCAAECETCTQRSPDLCMSCKDNYFTSFSFAGQTSGPCRPCSDTRSLNGIIGVPGCNYCTLPVTNGTDENPVPVICLTTESANNSKMMSSGAVAGITITVLLIVGGAVAGVLVWFFLFKNRKGSAKRNARRRFHPDETSTSLLSQDYGSSMI

SEQ ID NO: 236 - protein, 721 aa, Giardia intestinalis
MVASIYTALTLALAVATIEASIAAGCTSDNDCGGGSNSCSITINNLKYCSKCAAGKIPINGVCVSSGDAKGNTCSATGCTQCTKGYFLHYGSCFNLDTDSPGNFVCDFVDDENEQLVDGYCTQCNQDGYSDNPKKSSTTQSCVACFGTDGVSGCNTCTAIPDTSNANGYLVICHGCSDKDMIAINNKCVPIGGVEDSISGCVHYSSSGYTSCSRCGAGFLQYASTCLLANGDYATKICETSNQIHVADTICCKQCKNTDLAIIDGDCSTSNFQCTCSGGSCTQCHGKNFVYHYGGCYHIYSTLALSICTGGVADGGKCLQCNTSQASGLFANPNTNEIQACISCGDTDKGGVANCMECSYASSTVTCTKCADGSTPTNNQCNPVTPPGPPVGNCNVLACKTCNTTDTTRCAECHKRTYLGLDNTTCVSKCSTQNSGQDHYYGNSSTGACEKCHSDCQDCTGPGQNQCTACVPEKYVPGEVGSCISCSSTQSGTAYTGIQNCVRCHKSDYITTDLRCTACTTGMVPNFGHTHCISATTCSTANCELCQSGPSTCDRCSENFFLTPDSTCISDCTTLGAYVGNTQTRKCIQCTEGCVSCNSDLRCTSCQSNYAIVNDMYCFRCDSVDSNSLITGISNCIKCRAPSIGHGSVHCLEYGSQPSNNAGSKNLTGIAVGTTIAVLIVAGLIGFLVWWFVCKRKPTKAGPLNTLRANSSAVGSRVGLM

SEQ ID NO: 237 - protein, 673 aa, Giardia intestinalis
MVGEVEVCTECKNTGNVPINGQCTTVANAANCKKVGGGELDPNAQTCGQCTDAYFLYKGGCYQIGQSPGSLICADKQASGTTGTCKACVEGYFTVSSATATQDSCVACGDENCATCTEGTTPQKCSKCKAAGEKLYLKKESSGTGTCVSAVECTAAGSYFPDSTSDPKECKACEATCATCAGAAASQCTSCKTDKPYLKKDSPTNPAGTCVAADGCGDGSYADTSSKECKACHGDCAACTGALETDCTSCQESSKYLKVLDAENGSGQCVAPSACTGTHFPVTDDKKCYLCNTANKGGVTDCQTCSKPEATVVCSACTTDTNKPNVAGSACVACSVANCASCDNANVCALCTNGQPPAGGACPSCADKNCADCTGGDGACKACKEGYRLSGGACEQCTVASCKACAGSKDVCEECMQDTVLSPSKLACSATCPVGSYTSGAQCLPCDASCASCDTEGPAKCKSCYPGYVLSYAADGATGTCIRECTGAAAAGCESSMCNAKIAGSSYCSKCVAGQAPINGICTSVTRSARDATGCAPSGGQCTACTGEYFLQFGGCYEKTKFPGNAVCTSIGASGKCSACVSGQAVAGDGTCPSCADNCETCAASTPSQCTKCFAGFYLNTAKGCTPCSADSAPITGIKNCMSCDPPSSTQGAVTCYVTQDPTVDPTDPSVNK

SEQ ID NO: 238 - protein, 520 aa, Giardia intestinalis
MRLHSTNVLTPAYHVRLSHPASRMTRYHPVTRMLIDVPSATEACVCSLFVYSTGASLCNGRVLNYRVTPRYCDLDVRKASLDGRYSTTGAGCPAWCGRGRFSSVADAVRGRSRSDSGRADVCGREGLHQVHPDGSATAVTCTKCAKGLYLKTDGGATSCVSATECPEGQFPTTDDTGQTICVSCGNTAKGGIANCQTCSPLTSVSRSSTVFIKCTACSIDRLSPLGDACLADCPYGSYEGSPNTCTPCHPLCASCNDNAGADSCTACYPGYVLSRATDSPIGKCILECTEEFGANCETCTADIVGSKYCSKCKSGYVPVDGVCVPVTQRTIQECDPSAGVCTACPGNDYVLLSGGCYNTQTFPGSSVCLAATGGKCTDCTNSQAPDDKGSCPSCSEGCSLCPSGPETCLACFSGYYKSGTKCFKCTNSNANGSPTVAGIPNCVSCIILPGSSTLTCYVKIDKGDDTKKNAFPASAIAGISVAAVVVVGALIGFLCWWFLCKTKRAGVSSSTTALTRPTSS

SEQ ID NO: 239 - protein, 261 aa, Giardia intestinalis
MCTAVLGGSKYCSKYAVGYAPIDGMCTKVATTRRDTSVCTASNGVCTACTGANYTLLSGGCYDTQALPEMAVCTAATDGSCTTCANGQSANSGVCPACAEGCSACNAGQTQQCTKCFAGYYLDNTAKACKKCSENSNGITGISNCVNCTPPTSNHKAITYCSKIDSSAIGTRGDGVDKNVFSISVVACASSLSTLTIGGLAGFFVNDRPVTIAGMSLLEETDQSTVYESASLCNVPTKLLRRRLSKSFLERTKTSTSAHKE

SEQ ID NO: 240 - protein, 941 aa, Giardia intestinalis
MLLLLLLTLLATVVCAQLDPCAYCLYNKCLQTEHGSLCTHCEAGYAPLEGQCTIVDDSFCLVGSASGGSCSQCGYGYMSFLNGCYSAMAFEQLSKVLGNKVASTSTSYASNHVFLNGQALFTGCFMPDELPINGACTEDTDKWCSQSGETDFSYGTSCLTCTGTDVFYFKGGCYSTKTEPGKLICKTASDGICTACNTDHNHVFTNPGTSTKKEHCISCGDGYGDDEYSGVENCGTCTAPSGSNKKATCSACPDGYKFNVAKTQCFTCALQGCLNCDGYNSCEKCETNFYITEQSYTKICVTTCPTGTFPFVDSAGNKKCFSCSTFDKSDAITVERIPGCGACTVSSNNRLTCSTCLQGYQLTATGCKQICADVSGKCSSDACTVAIGSMSYCSNCGNTSNYAPINGVCTYVTVNDKSGCREQETITGVCSRCGEGYFLHKGGCYKADQAPGNLVCSSVGTGSMSPGNIGAGRCSICGPGYRGKKGFCIPCDNQHCLEYISDTCVCTACENNVLLLQGQCIPLPDSGCKVPYCSLCEESREVCTRCEGSYYVTPLNGCVRDCGDIMGYHNNADLGKCVRCKIKNCYKCSDSTRCLECSTGYGLTDDQQCTQCPENCLACSHYNQCTTCKSGYILGDSKVCESESDYRVDCAESDAKYIKYELTRHLKGSVLQRVTASMCSKCTPGKVPINGKCVSASTRTLRCTPGTGEDAGKCTSCSGSASNSAFLYSGGCYDRETDVGRSICLNVGSNGACAKCSRGFMFDTNRGECTPCPSNCLKCTSAGCLRCDPGWLRHEDKCVVCKKGCLECNTSPDKCTSCTTGYYVAGPTTSSGGNVGPCRSCDDTREVDGWRGVNGCTICVPPVFAGEVLCLSKEKIIDSSSRSLSSGAISGISVTVVIVVAVIVGILVWKFACKSKSSGRIRLVDMDVSINTSQHMSSSYV

SEQ ID NO: 241 - protein, 1609 aa, Giardia intestinalis
MHTWVFALIICTSSNHHHCLHNSNRYLMNDAPCHLPGKSNATTHILFEEAPDCPENCASCTDPSICEVCEHGFTLTNRGRCVDQCIEGDSETNCAVGHCTVFDDTLCSKCAHKDDVPAAGICNTGVTKCTKDDLGVCISCEPGHLLYQGGCYPSKSALAQSICTTDNQIVIEGKLYCSLCSNENEAPINGHCTDEFPSYCNADGGRCTSCIADGYFLLEGGCYSGAEHPGSVICAEVHDNECTECGSHYPLTAGVCTYCPIDHCLTCENESCSQCQKGYVLRSSGRCVKLCSEGNGLQSCAIGYCTAFGGTLCTKCAYEEDVPVAGICTSELTTCQKNSSHICISCEQKHLLYSGGCYATTGSLGLEICSLEDQINIGDKVYCSKCNQENEAPLNGECTETAANHCDVLDGVCTSCKTTGYFLFQGGCYTLASIPGNIVCAEVSGTTCTKCRDGYGIHEGECTPCAIEHCMDCNDNIADCNACDPKHFFTGAACVACEGEHCAACRENMCVDCTDKTECHACTIPNCVLCDPTSVECLTCQEAYELDEDGACTPLPASECPSSCLCTNNDVPALCTSCKPGFIAAGLVSGDTCLSCALEVENCGLCTYISESESIVCEECLDGYRMNNGLCEPCGKGCKSCPQRANKCEECFAETPYFNPALTECLATCPPNSVAVANKKCSCIHGYYSTLQGCEPCDESCDTCSGGEVDKCVTCRPGFFLASGSWKGQCISCHVGAFSDGSIIGVEHCSKCKGVPQNGDLVVMCEECDLGYTLKGEVCVSDDAGHEDCPSNCICTAESPACVSCQKGYFTLSTPSLETCIRCSTAVSGCKACTVEDVPLSRNTKDVVCTLCDDGKGLVEGECQSCHVTCKTCNNNPNLCSACNNPTYKLSLKGDQCVQECPEFSEEQNGRCVCLLGYSISSNGLTCTKDTSACPSVCICAVGNICSGCTDGYFTFDPSRTDAARCEPCSGDFCSSCGSVSNDAAVIGHSLGSNRRYAYRRSTKSINICVDCNDKRGCSACSIEGCNKCSTADHTECTECMPDYQLSQDKKSCEPLVPICPLGCTCTPGTSTCNGCADGYFEVDSADETNGRCMRCSIPTRYIPTRISRARRIQQLLSVRGKEIDQIGWKVVRDAAWDGVAGCALCKPPSSPGPAICTQCVQGKHLWVSGESTQCLDACPDGMGSINNVCFNCNDQNCLRCDNNLDSCTECRTGASPILNPETELVVCETVCPLGCVCEDAENSNICTGCQSGYYEVSVLARLVMRLRQADVHCKACLANCMTCTDGSTCSACADSYVLHQTGASCVQKCDQGYYDKQGKCTRCSDENCASCTSETTCTSCIGSSFLSGGKCITCDESCKTCGGSTKKDCLACPAGTVHSVGTGLGECLQECSATAAGNCALCNAIIDGTRYCSKCVPGEAPIDGRCELISVARNVACVTSGDGTCTSCPATHFLFNGGCYATSRYPGSAVCTSSSNGLCTNCADGFTSTNGICSNCVSGCSSCSSAAASACTLCTEGYFPAFSGSQGVCKRCDDTTITNGYQGVQNCRICVAPQQAGPALCLDASEISNKSSLSAGAITGITIAVLAVVGCAVGLLVWFLCCRRSKAV

SEQ ID NO: 242 - protein, 144 aa, Giardia intestinalis
MDGGCYETGKYPGKSVCTSAPTGGTCTSLASGYYLNSGTLVTCGTGCAECTNSDSCTTCADGYVKLNNAQTCTKCNAGCATFTGTASTCSTCADGYYLSNSKCITCDKSDGSITGVSGCLSCAAPSGSTGPVLCYLMKDSTCWR

SEQ ID NO: 243 - protein, 429 aa, Giardia intestinalis
  misc_feature (257)..(257): Xaa can be any naturally occurring amino acid
MFPVIWCLIVNALAVACSGSQTNCATDMCETINGVEICTQCVEGYAPVNTGCTAHATANTNCKKKSADLTAQSQICEKCEGSYFLYKNGCYQVSSSLGTTLCALADGGVCTKGTPGYFALPGAAPTEESVAPCNATAEITLANGKKYTGVASCATCTQPSAAEANTPKAATCTACETTTPTYLKTVDGVTTCVPKSDCNNGFFVEENATPKKCTACNDNANCVACTGSSSNQCTRCKADGTKPYLKKEGETDAGSCXDITGCTTGALYYTDDTDTTENGKTCKKCSEGVANCEQCTAPAQGKTKPACTKCTTPNYLKTAADGTTTCIEKTACKDDFFPKEDNSNGHKCLSCGDETSGVPNCAECTAPSQEGEKPACSECGSGYKLEGGACVSSSANRSGLSSGAIAGIFITAVVVMGGLVDFFSRAVRL

SEQ ID NO: 244 - protein, 283 aa, Giardia intestinalis
MAARRRFRAVMLIAFLLICAVIRADCASELTTAGCSTCTSDGQTCTACTNSAYNVQLNGKSCAANCPEHSTAKQNICQCDDGYSLNSAKTACERSVSAGCASELTTAGCSTCTSDGQTCTACTNSAYNVQLNGKSCAANCPEHSTAKQNICQCDDGYSLNSAKTACERSVSAGCASELTTAGCSTCTSDGQTCTACTNSAYNVQLNGKSCAANCPEHSTAKQNICQCDDGYSLNSAKTACEPSSTNKSGLSTGAIAGISVAVIVIVGGLVGFLCWWFLCRGKA

SEQ ID NO: 245 - protein, 640 aa, Giardia intestinalis
MQCQTGKVPINGICTETTQPDATTNCKKENDSPLDGSDQTCGQCVGTYFLYKGGCYLAGSGTGGKLCTSATDGVCKTPADGYFIPPGATKADQSVVACGETTEVTLKDTKKYKGVKYCTRCAAPPAAGDAGTAAVAICSACEETHSLNQQDNVCNALPSFQCVSGKLEPLGDTQVCTQCSEGYVPINGICTAKDDAANCKKAGGGALDSNAQTCGQCTDAHFLYRGGCYDSAQGIGKKLCTKAAAGVCTTPAAGYFVPPEAQSKDQSVLSCGETTDLVLVSNNKKYKGVAFCSACTAPSPAGDVSTAAAAVCSACQSGYDLLQEENVCRQSNGCAIPGCKTCSSDKKTCNECESGKHLTPTKEACLSSCPAGSYTSGSACSACDPSCATCAQAGADKCTSCYPGSALVYSTDGSAGTCIPECTGAFAEHCAANSCTGKIGGSNYCVKCDNGYAPIDGVCTAVGGAGRAASACTPGDGVCTACTGNYYLLSGGCYQTTKLPGSSVCTEVKAGQNGQCQTCANGQSANGQGVCPSCPDNCATCSTTSTCSACFSGYYLTADTCTKCTENNGEVTGVTSCLSCAAPSSGKGSVICYVKTGSNSTGSGTNLSSGAIAGISVAVIVVVGGLVGFLCWWFVCRGKA

SEQ ID NO: 246 - protein, 923 aa, Giardia intestinalis
MERRQTTLGLPASMPPLPPPVRIEGCKTCSADKKTCEECAENKYLTPTNQCISNCATIPGYYGTAENGKRVCKKCGVANCVVCGATGACDLCTDGFYGPSCSKCHESCRTCSGGAGADKCTSCMPGSALTYGSAGNTGTCGEGCVQSSESGAGKCETCGLTVEGTKYCSKCKIGTEYPQNGVCATKPTGRATASCKDSNIANGVCATCADGFFKMSGGCYSTGQLPGATVCAQTQAGGTCKTSADGYKLDADTLTTCPSNCKVCSSDTACTTCADGYAKLTSATTCTKCDAGCATCAGIASTCSTCADGYYLSNSKCIACDKSDGSITGVSGCLSCAAPSTGTGPVTCYVTQTPAVDPTDPSTNKSGLSSGAIAGISITVTTIIGRPVDKMSTYIIHTSVSAIVRPIQSPYPSPKTSVADKHSRMPTPATGGSSVPAFTAKDICKRIDSVLGRGSLGTVYSIKGHPGLAVKEIPIDEQDEGSVNTIRSELATLPALSHPGLLKCHQVVEDGSFIYIIVNRYSRTLDGLLIEHKRARTLISGETVFSILRQLADALAHLHGALVGNASGTTACRTAHRDLKPTSILLSGDGECIAIAHLGRCKDALWPEGAMDGPKPYMAPEVLLEGRTISASDIWSLGVIIYELATLKRLDFLEGKEPKDVFINGWRPDLSAVEDDSIKSILERIFVLAPVKRPTARDLCELLRVSDASVVRMRLRAMMLEEALNEANARIASLEKELQTKIDDLERRFTGVFETLPKHDMQASAHHTSASAPLSAAVSPALPALEKSVSCTPLVHAAIAGDAKAAEGRLSGDDQMNDSGDAVSVPATGTSGGDGAEPLNPAGDHAATALMSAAERGDVEAVRALMPLQKEWRANLFGSGKTALMMAAMCGQAEVVGYWWSTRAVDRIRAIRLLLCTQYMITT

SEQ ID NO: 247 - protein, 195 aa, Giardia intestinalis
MYAEGYMVDGGRYGTPVRVRAASQCTQQANQQNCEANSCNVQIGSNVYCSQCKTGGNVPIDGVCTAKDNATDKCMKDGSTPIGESNTKYGFCPSGYFLHKGGCYKKGQQPGQTICTDTSSTLGPCESCASGYFNNPAATDNTKESCIACGDTTGDTTNSNKGVQNCATCTVEGAGTTGKTAKCISIANPSRETSS

SEQ ID NO: 248 - protein, 401 aa, Giardia intestinalis
MQTADTPAPTNGPRSCVTENCKTCSNEGQENEICTECEPTHYLTPTSQCIDECGKVGNYYNGMNDNGKNACRACAVANCEACDEQGKCILCKDGFYGKACMACNSACKNCEGSAVDDCVECPAGSALKYGGAGDKGTCEAQCKATTGSGSGNCEECGLTVDGTKYCSKCKETNEYPQNGVCATKPASRATASCKDNAINGGVCTQCADGFFKMNGGCYSISQLPGATVCTQTQAGGTCKTSADGYKLDADTLTTCPSNCKVCESDSVCTTCMAGYVLTDPTCTKCTSGCATCAPDATTCTACLAGYYLSKSKCIKCDADDSSGILGVAGCTACTAPTSGTGSIICYAGPAIDSPTDDPSDPSVNKTGLSTGAIAGISVAAVVVVGGLVGFLCWWFICRGKA

SEQ ID NO: 249 - protein, 159 aa, Giardia intestinalis
MVKTAVDGTTTCVDKAGCTTGQTHFVEGSTTKACIPCSDNTKGGILGCKTCTAKGQCSACLEGYFGSNACAPCGANCATCTQAGDDKCDTCKPGYFKQGDSPGTCTPCDDTASGIPGCAECTFSGSLACISCKPNYKQSGLDPVTCTRTCEDDSACEAH

SEQ ID NO: 250 - protein, 472 aa, Giardia intestinalis
MYMGGCYQPSTAPGNVMCKAATEGKCDTPADGKTYFVVPGATKTDQSVVACGDTTGVTVDTNKKYVGVDGCAKCDAPESLSAAGTATATCTECNANLYLKTVSSPTPTKSCVTEAACKEGSTHFPTTDSSNGDKKVCVSCSQTSNGGIADCAKCSLTTSPAGAGAAVTCTECDSTKKLSPLKDACLDGCPAGTYEIGDTNKVCTPCHASCAECNNNANQDSCTACYPGSVLNRTTDNGSTGTCIPECTGRYAENCKAGMCTADIGGSKYCSKCKSGFVPVDGICVSAGTTRVALTGCTSKGDGTCSACTDKYFLESGECYQSTAYPGNTLCSSAADGKCTTCANLQTPDTNGSCPLCAAGCDMCDTPKTSTCWGCLPGYYLSTDKCMKCDSDDGSITGVKDCVSCDPPDSNQGSVTCYVTQEPTVNPTDPSVNKGGTSLSTGAIAGISIVIILIIGGLAGFLCWWFLCHKKK

SEQ ID NO: 251 - protein, 300 aa, Giardia intestinalis
MLLAIYFTMGALAIECQSGEAAASKCTSGKCESVGDTQICTSCETGNVPVNGVCIAHGEATVTGSGCTKASNGAAVDQDDTQCGKCGNGYFLFKGGCYDASKAPGNLICSTIEESAPGMCKTCAPGYFKNPASTGNDATKQSCIACSDETGANDNTGVANCATCDPPETPGQNNSPQKATCTKCDQTKYLKEGACVESSGCAPDTEFAKQDSVNGNRCVSCGNTESGVDGCAKCTASSGESTKPTCTECNNNKIVKMEPSGTSCVEEAACVDGFFVETVSGTPSKKCTACADSNCAVCKK

SEQ ID NO: 252 - protein, 413 aa, Giardia intestinalis
MCETIGAVEICKQCKTAGKVPVDGTCTAYGTASTCKKSGGGSLDGSEKSCEKCEGAGIFLFMGGCYNKDNSPGNLVCTTVADGKCTTCTTGGSVFQNKATQPTTGRECILCSDNTGSDSNLGVANCATCTAPTTTTGTATCTKCVSPNYLKPDGTVCGEKGTACASNTEFGKEDSVNGNKCISCGDATDGVTDCKTCTAPSGESTKPMCTECNNNKIVKTVTASGKSATSCIEPAECKDGFFVNTADKPNKCTACTANCNTCSAAEANKCSICAEGYFVGAATGSEGPCVKCDATGSSGFVGVAGCTKCTRPNTSGASGTAICDECEAGKKPSEDKTKCNPCADTNCSFCDEQGACQKCSDGYTLEGGKCASSSTNKSGLSTGAIAGISVAVVVVVGGLVGFLCWWFVCRGKA

SEQ ID NO: 253 - protein, 410 aa, Giardia intestinalis
MQCGDKVGATLEGRTYAGVRGCAECILDGSATAVTCTRCAKGLYLKTDGGVTSCVSAAECSKGQFPTSDSNGGSVCVECSDTTKGGIDNCAECSLLTSKARSSTVLITCTKCSDNALSPVGDACLRKCPAGSYETTTTPDNTRVCTPCHSSCAGCNNDPSQNSCTSCYPGFVLSLRNGDPIGPCIPQCTEEFGINCEPGACTASIAGSKYCSKCKSGFVPVDGVCVPVTQRTIPGCNSGSDGTCASCTDSYFPQSGGCYNTQTFPGNRLCMDAQSGKCTSCANGQTADNSGSCPSCPDGCDLCDKSNTETCEGCFPGYYLSGTKCIKCNTSNESITGVKDCVSCAPPDNDQGSVTCYVIQPGVSPNDPSVNKGGSRLSTGAIAGISIVIILIIGGLAGFLCWWFLCHKKK

SEQ ID NO: 254 - protein, 356 aa, Giardia intestinalis
MYKEEMRSVQTAGTCTTSPEKCNPDACNVQIGNSIYCSRCKDESSEFPINGVCTNQKDDNTCTAGGVCTSCKEGYFLHKGGCYKKGEEPGSLICKPTGSTVGVCDECQAGYFKNPSAANNKQSCIACSDTSIIDSVTGVDGCTACSGPTLAGTQDAPKTTTCSACSNSKIVKTAKDKTTSCIEEADCTKAEGFFIDSTSGKKCSACNENCKTCSGAAAQCISCKTDTPYLKKDTDSDTGICVDAADCTNGHTYYADDTVDPTSGKLCRKCAEGGVTVCTKCEKIESGVVCKECPGPDNTIFDLGRKSCVAECPADSSPDTDSVCVQQGFRLFLQRTSGYLRCGYPHRRRVLCHKKK

SEQ ID NO: 255 - protein, 352 aa, Giardia intestinalis
MKEDRTKCFGSCLALGLGYYNNSGTCTRCIDNCVFCISGDSCSQCAEGYYLDTSAGTGVTTGTCKLCATGCSTCNGGAANECTTCLSGYYFAVSSKETQTAKCVLCNTTDETGYTGIQHCAACRSTVGNNGSKNVICQKCEDGYLKETDQGATVCTLPAPDCSVDLCALCVEGDATKCEHCVADSYLCPRTATCTKDCATCGASMYADEDLGECQPCNIANCQVCATGLKCDSCTADSVPVSPDVYHTACLGCDDTAGMNGWTGLAGCKTCELTDKGGGSVNCLDPGYYRKGGLGAGGTAAIVIVVLLVLAVAGFLVWWFVFRKRDNFPKRSRGGYTLLTKTDSYDYHQSLI

SEQ ID NO: 256 - protein, 182 aa, Giardia intestinalis
MNGGCYEMAKYPGKSVCTATKTGGTCQTSADGYKLDGSNNLVTCSRNCKVCNNDGACTTCMPGYVVSKSDCIQCAAGCATCAGTAATCDICTDGYYKSGSKCIACSKSEASIIGVSDCASCAPPASGTGSVLCYFMNSDVIDPDNKSSLSTGVIAGISVAAVVVVGGLVGFLCWWFLCRGKA

SEQ ID NO: 257 - protein, 128 aa, Giardia intestinalis
MPGYVVSNSACTRCSAGCATCTGSASTCDTCTDGYYKSGTACVLCTEDGAGGVITGVANCATCAPPTGGSGPVLCYLLKNDAGGDITAGDSDPNLSSGAIAGISVAVIVVVGGLVGFLCWWFICRGKA

SEQ ID NO: 258 - protein, 181 aa, Giardia intestinalis
MNGGCYSTSQLPGSTVCVTAPTGGTCTKSEPGYNVNSGTLVTCGVGCAECTNSDSCTTCASGYVKLTSAATCTKCDAGCATCTTAASTCSTCADGYYLSNSKCIACDKSDGSIAGVKDCLSCAAPSGSTGPVLCYLVRDSASVNKGGLSSGAIAGISVAAVVVVGGLVGFLCWWFVCRGKA

SEQ ID NO: 259 - protein, 350 aa, Giardia intestinalis
  misc_feature (328)..(328): Xaa can be any naturally occurring amino acid
MKEDRTKCLGNCLALGLGYYNNSGTCARCMDNCNLCEDGESCSQCVEGYYLETSDADPPQSTCKVCTAGCSACNDGTETSCTACASGYYLASNSRAERAAKCVPCGTDENGYSGIQHCVTCYSTLGSTGAKNVICQKCEDGYLKETDGGKTICETPPPTCTVPMCALCVEGDATKCEHCVADSYLCPQTATCTKDCATCGASMYADEDLGECQPCNIANCQVCATGLKCDSCTADSVPVSPDVYHTACLGCDDTAGMNGWTGLAGCKTCELTDKGGGSVNCLDPGYYRKGGLGAGGTAAIVIVVLLVLAVAGFLVWWFVFRKRGRSSXRNRGGYTLLTKSDSYDYRQSLI

SEQ ID NO: 260 - protein, 209 aa, Giardia intestinalis
MCVLATARELTAVCTPKNDGTCESCKDTYFLQSGGCYQSMMYPGDTLCELAQQGKCTTCANLQLPERDGSCPLCATNCKVCDASNAKTCRGCFPGYYLDSVDNKCVKCTDNSNNNGNTIVGIPNCISCVPPASGNGPVTCYVVQESTNDPTDLNTNKGSFSTGAIAGISVVAVLVVGALIGFLCWWFLCKTKHAGVSSSTTALTRPTSS

SEQ ID NO: 261 - protein, 446 aa, Giardia intestinalis
  misc_feature (268)..(268): Xaa can be any naturally occurring amino acid
  misc_feature (354)..(355): Xaa can be any naturally occurring amino acid
  misc_feature (357)..(358): Xaa can be any naturally occurring amino acid
MVRAEAKAQLGTDQCVEVTGGAANTCKTCGAIIGGTKYCSACNDSGSTAAPTDGVCTADNAVCSAKSNGVCTTCTGSSFMFQGGCYATANAPGNTMCTQAANGICSAAAAGYFVPPTADRDNSHQSVIPYGDVEEIAVKDNKKYKGVAHCTQCSTPATAVDTTNAKAATCTACEDGYFVENAACTQCHSSCLTCSAAGDSKCKSCKDGYFLGVTSGQTGKCVSCGDATGSGGWTGVTGCAKCTKPASAGPATCTECNTELYLKTLTGXTPTTSCVTAESCGEGFFATTVGSVKKCVSCSDNNNGITDCGECTAPSEPTNKPTCTKCTGKYLKTAPDGTTTCVEKNACTNDFFPXXDXXNGHKCLSCGDETSGVPNCAKCTAPSQEGEKPACSECTSGFRLEGGACVSAGGVNLSTGAIAGISVAAVVVVGGLVGFLCWWFVCRGKA

SEQ ID NO: 262 - protein, 134 aa, Giardia intestinalis
MAPSEPTNKPTCTKCNTKYLKTAADGTTTCVDQDKCVTDSFPVTNAQTGNKCVSCGDTDAGIPNCAKCTLSSGVTKPTCSECNSGYKLEGETCVSTGGPNLSTGAIAGISVAAVVVVGGLVGFLCWWFVCRGKA

SEQ ID NO: 263 - protein, 210 aa, Giardia intestinalis
MDSEYPQNGVCSSTTSRAATCNDGTIQNGVCNTCSNGFFLMNGGCYETSRYPGKSVCTEAAQTGGTCQTAAPGYNVDNSGNLVTCPEGCKTCSDANTCATCVDGYVLANNACLKCDASCLTCETEATKCTACASGYYKAASAAGPCTSCESNSGGITGVRGCLSCAAPSTSSGPVLCYLVGMSALLLVSQVPPTPCQYVTWWQSVPRSSE

SEQ ID NO: 264 - protein, 539 aa, Giardia intestinalis
MSSCHQSCVTCSGQDEVSCTSCNSTSFLALQDIDKGYCISCSVETSVNGYVGIERCLRCTLPSSTDTKPTCLECSELDYMVSIDGRSCVTSCGVGALPNYYTRQCACTNGYGLNRGDRAQGCVPCKVSRCSLCTANADLCNECEIPFGLSLDSQKCLAIGGCPANCVCVNDGTDLGTTCNSCEKNYFLQPVGRICLHSCPLGYALNPTTNNCDMCSANCYSCEEALETRCTSCISGYVIQRLNSDIPTTGRCIAECAEAAVGSCIECQAILGSAKYCSRCASAFFPLDGKCVSVPDQQPLLCISADRGVCFKCAVGYFLHQGGCYSSLYEPGKSVCAAAERTNPAAYGTCRACTHSYHRTSDGICISCTMEGCFQCSSSPDVCTSCSNGYYSTTISSSADEVRCNRCATGCLVCTDSSPSTCSQCAPGYFGPNSVYGCIRCDDSTVSGNLKGIKGCKQCQLSSSGASVICLDDNPDSSFTLPPLDTNKTTLVLSIVLPIIILILASSIIALVIVLVRRKKAKRLSPSIASVALNTVISG

SEQ ID NO: 265 - protein, 195 aa, Giardia intestinalis
MSTCSKCLPGYFLKTGSPNECVLCGDTAKGGIDGCAECSGTTGSLKCTKCKPNYNPSGEETNLTCTKVCEDETACGGTAGSCGAIVVDDDGSMKHYCSYCGESTKFPIDGICKGDSAKGSNTCDKGVCTSCTTGYFLYMGGCYKADQPPGNLMCTAAAGGICTTPTGQYFKVPGAASTDQSVLGCREPPRHDGKW

SEQ ID NO: 266 - protein, 122 aa, Giardia intestinalis
MGGYFKTSSNTCTKCDAGCATCTGTASTCSTCASGYYLSNSKCIACDRSDGSITGVSDCLSCAAPSSNTGPVLCYLMKDSTASNSDPNLSTGAIASISVAVIAVVGGLVGFLCWWFICRGKA

SEQ ID NO: 267 - protein, 276 aa, Giardia intestinalis
MCTSCKSGYFMHRGGCYKYDTEPGNMVCKDTTASSTQGTCDECQAGYFRNPVTPLAATHQSCIACNETTAVDYNIGVANCAECTAPAASGSSGSNQKATCTACADGYFISGGGSACTACNDGTNGVAECTACVPREDNPAKATCTACSGSKKPSLDGKSCYDCTVGNCASCNSKGACQKCDSGYILDGSSCIKNECTTSNCKTCTNPKAVNEACTVCVSTHYLTPTGQCISNCAALSGYYGDTDKTCKRCEVANCVDLQRSREVPDLQGRLLRRIV

SEQ ID NO: 268 - protein, 236 aa, Giardia intestinalis
MCTAVLGGSKYCSKCKSGFVPVDGLCVSAGTRAAPTGCTPSTTTAGTCESCKDAYFLQSGGCYQAAVYPGNMLCTTTDNNGKCTSCANGQTADGSTGSCPACDSTCATCEAANAKQCKTCFSGYYLDANKACKKCSETSSNIQGVENCVSCLAPTSPSTPTPVTCYVTQEPSVDPTDPSINKGGLSSGAIAGISVAVIAVVGGLVALTGMWTRASPISQTESDNRLLPGRLELFEQ

SEQ ID NO: 269 - protein, 232 aa, Giardia intestinalis
MCIPECTGKYAENCADGQCTAKIGSSKYCSRCKTGFVPVDGICVSVASRGRETTICTPKGDGTCESCKDTYFLQSGGCYQSTAYPGKTLCEKASNGKCTLCANLQTPDTNGSCPLCAAGCDLCDKSTTKTCSACFPGYYLSTDKCVKCDANSDNGIKGVTNCVSCDPPDSNQGSVTCYVTQEPTVNPTDPSVNKGGSSLSTGAIAGISIVIILIIGGLAGFLCWWFLCHKKK

SEQ ID NO: 270 - protein, 181 aa, Giardia intestinalis
MSTCSKCLPGYFLKTGSPNECVLCDDTAKGGIDGCAECTNEGSLKCTKCKPNYKQSGSNSVTCTKACEDETACGGTAGSCRAIVVGSDGNMKHYCSYCGESTKFPIDGICTDQSQGNTGCVNNVCTSCTAGYFLYMGGCYSVSKEPGSLMCTQAPGSICTTPTGQYFAVPGATDKQQSVLA

SEQ ID NO: 271 - protein, 734 aa, Giardia intestinalis
MCVPCAVANCASCELDADYCTECVQPYTLTGVGAGAYCTKTCKRIGEGACSWNSCTVMDGTMCSECASGDYVPIDGACTPYSGSARSLASPCVKDSRKGLCTSCKGNYFLYQGGCYSASEYPGTDICDERNTAVVDGQVVCGRCLVDGEVPLDGTCTKPKDGLICSKGTCSQCGEGMFLFEGACYTKGEAPGTSICGDTVRSTAGCTTCKAGFAPKNGGCVRCSDSNCGACASDPNTCTACLAGYYIQSTSCIACHPACKTCSKAGADKCTECSEGYFATFATSQSGACLSCSDTTGKDAWVGVGGCRLCTAPATAGPAVCQDCLSGYKKLSNGGTHTCHVVCPTGYYETAGSCVQCAVDNCAACTSTACTSCASGHTWDGEQCVPKTCPAQCVCRDQSISCIGCSASAVEVRPSHSGSSRCLLCSDTRANGGWTGIDGCKTCRLADSVGPVVCLECEAGRKKLTLDGVLSCPSACPADGFWTNSSECAPCASGCLRCTSDSACTACSSGYYPTQTAVSAPSHCRPCDDTASRDGFVGIAHCAVCTADPAAKTLACSACAEGYGLSGGSCAPCAAAGCARCDGGVCTSCRRGWYLAGDRCLACPSPCTACSSAASCLACADGYFQALPLGGPQECVPCNQTALQGLQVAGVYGCELCRAQAGSGTVLCLRCRDGGLPLENYCGAPPAERRLGPGAIAGISLSVLVLVGGSVGLVFGLVASKRTSQPDGLRPLTA

SEQ ID NO: 272 - protein, 372 aa, Giardia intestinalis
  misc_feature (361)..(361): Xaa can be any naturally occurring amino acid
MGHPPIKRHGVCALFMGGCYSVSAAPGSGVCSEARDGVCVRRAEEVRAEVKEPRTGCQAQESGGPETCHTCGAVIGGVSYCSQCNVDSSGTNGAPTDGTCQADNAVCSTTLDGVCTTCTGSSFMFKGGCYRTGQDPGQTMCKTAADGVCTEAVTTKEYFVPPGADNTHQSVISCADETPVELADQKQYKGIANCLTCTKPTAGKANTPKAATCDECAPGFFVASSGALCSACAENCLTCTDGTATNCKSCTANTYFLGAADGSQGKCVSCGDAAGSDGWKGVEGCVKCTKPASAGAATCTECTGDLYLKTDGSTTSCVTAGQCNNGFFPTTDSNNKKVCVKCSDNNNGGIADCAKCSLKGXARQSRSGGHVH

SEQ ID NO: 273 - protein, 1335 aa, Giardia intestinalis
MLVLLVGPLLLQVVYMEASSPTETASLSGECYNFFVLGEDTLCSDCRAFSNVPINGKCVPNDPNICIVVQGYSTKCGSCASGYILFKDGCYDLSGKYAPLICTAENRYVLGGVTYCSRCAYLDYVPVDGVCSSTSPFNTCSNNMCTSCGFSYFLFNGGCVSSSSNLGKLVCASRPENGKCPQCADGFSADSTGMCILCTVTNCASCTDGGSTCTGCKEGFFLDSTGACKLCRHHCATCSSEYDCTKCRANAQELMVDSERVCVGCGDTSSQHGGYLGVEFCSHCTLPPIPGQVQCQKCLQNYYSLTDSKTGFVTCYAVCPVGTYGDSYSKSCKNCSANCQVCESAYGCNECVPGYYVGFMSCERCRTPGCSRCTSRYTGETCEMCLPETPYMNLAGTECIAACPAGSKADTSTPVKCVCDFGYGLTGSKDSCVKCSDKYCKLCTADPTVCTECLYGNKADGATECPAPVCADNCASCTQAGHGLCDVCQEGFRLTTDSKCAKCSDQYCLACASDATVCTSCQHGFRVSSSGTCVQCGSGCKICTENSCTKCNNDAHFIGIDGINCDTQCPSHSTSVSEGSVSRCTCDDGYISDPETKLCVEEPKACPIGCVCETAPVCSGCADGFFENDPTKTDASRCRSCALATDSQGAQIMPGCKICQRVENTVLCRECLSNYKLYDADGVIHCLQNCPSGTHDTGSHCVRCSINNCAQCNADKSICEACAHDYYLWENECVSCNSLECAECGLPNTCTKCMNTKKCKACAIPHCRTCTASGKCTVCEKGFYGPTCQPCPSNCLTCSSGDSTVCLECQPGSIMSMGSCYNVCVEGTGSGKCAAGSCNSETGACMLCSVLSEFPINGVCTPNPHGNDCSAGKCTGCVSGYFIHSNGCYSLTAAPGNGICTASLSGRCTACHNGYSLQGSECVPCKVTGCAKCASDPATCDLCAIETYVVDPAGSSCVSSCAISGFGVSSSSRHCILCADQNCLDCANAANECTRCRSGYYLVAGKCMACHSTCATCSGPGEDNCLTCVRGKVHSTGTGSSTCVNECTSNSQNCLACSSIIFGTAYCSRCISGHYSINGDCHMVARSIVCLSGENGVCNSCAPGYFLYAGGCYQSERLPGSYVCAQPATDGEAGRCSKCQPGYAPLSGSCVPCENPNCQVCEYSSNICTVCADGYYGDSCTQCPKTCASCNNNLQCNKCADGYFAATDYETFDPSHCVMCSDEEGRDGYVGKKGCLSCVGPAAPGPVLCLSSNDSPVPIAPVTSTNRLPLTIGLSVTAVILLLAALAIVLWKLVSTKKLNRSKYASMSNSSAELLAGASGNNQSTMFDSVSISIN

SEQ ID NO: 274 - protein, 611 aa, Giardia intestinalis
MCPSSDRGSGRQRRHLLSERAPPHGQQAAVGSPHRGSGGRADNISSPARSLSPAVRGRPFGGSSVCGAMATMFEAIILASCILQFAWAACTPGSAGCEACGATIGGVNYCSKCTDANYAPVDGECVDVSQSTPDKQFCPQNAGGRCTQCARDSFMYQGGCYQVGQEPASSLCTSTDRAGVCVIAASGYFVPPNANSRQPSVVSCSDTAGVTLGGKTYTGVAECTQCTAEGLTDTQGGAARCVACGSKKPNKAGTGCFTCAVENCATCSADGTCETCTDGTSNTQCQAPGNKCHNSCQTCVDNVPPDVAKCKTCKADAPYLKVASSQATEGTCVTAAECTADGTHFTKDNVQINSSPIKVCLPCGATEGVAECQICKSESDTASPTCSVCEATKAPNAAGGQCLACNIANCVRCNSAETCAACGPGYVLVANECVACTTIGCKTCTNNADSQTCSACMDSTQKVSADGTKCVACGVSNCQSCSEDNVCAACTNSGEKPNTTGSECVACGIAGCSNCNAQDKCETCEAPKKPSKDQKSCTECKDKNCAFCTGEGACQECGPGYKLEGETCVSSSGNRSGLPTGAIAGISVAAVVVVGGLVGFLCWWFICRGKA

SEQ ID NO: 275 - protein, 1299 aa, Giardia intestinalis
MAGFFIVLLIALFRCKQCDSTIPNCLDCLTLDRSCCRLCQEGFLPVNGLCVEAAVSMSCTSYLGGACTTCLSEHILLHDGNQMGACIACSHTMLALGPGCKDCALVGGVPHCFACHPNYLSISTASDSGVALLRCTPLNDDHLSLEHHQRDSSRPFSRTTCTVSNCQACTSQAPDVCVQCTRGYSLINGGQSCVCSVSHCAACSSTDGLQCTQCLTNYALTSNRTCACSVRNCIDCDSYGTSPCLQCAPGYKLSEDGSTCSCGVDNCSICDSTDGAYCITCVTGYIQSYSRRSCTCAVEHCEECFPADGSQCLRCVKNYELYYDFKKCAGIMDNCLYTSPLDGLMCSVCNSGYVTASSGAICVDAKCHVLYCEQCDGTLCTQCKKGYSLMNGGLECACSASNCLICNPDDGNLCFKCIGGYDITPSGLCECTLQNCAECSQDGMSCKACVNGYRQGESGCECSLDACKTCNPTDGQLCDECYLNYDLVHGACVKKIPGCIAASLVYENVCELCDTNWELSYGQCLCKVRNCDVCHENGLKCVQCVEGFTLQNDNTECACTLANCAECDPRDGTECLACTTGHQPDAHGHCISDTCSINNCKRCASSTTCSECYDNYDLSTDKQTCTCMLANCSKCKPSNGQQCLECKTGYKLDMLMNQCLCSVHFCETCSPSDGSRCDACIAGFIKGPTSTSCNCAVDNCRVCNLSDGTKCEICDLGHTLTAGTCSPTVAYCKSYSKSRGCIECELGFSLMPLNLECLCTVQNCDTYSPTDGSECKSCVKNYLKEGNLCHCQVARCLRCDSTDGELCSTCIKNYVLSEDKASCECSVPNCMLCISRDGGQCYICEDGYRLTEDASCEEVPCSVMDCLSCPPDNPDICLVCRKGFWPADDRTRCACSDPACSECDFEDGALCLDCNANYTEIGSKCFCSRPYCVKCDIDDGSICEQCEEGFVLTSANACILRVCFAGQDNCELCGTGAHANKCLMCINGYVPINGVCVQDSKQDICIQSLGVCTSCVSTYFFWQNGCYPCSMIPNCIECYMTSAYGPLCKMCEAFYTLRGGKCQLDPYCSRGCECDDNLQCIGCITGYVMMNDICTLCEDLFYMCAECTSTFCIRCFDGYSVVNDDCVLGTCKEGTHGCLVCANDYTCMQCRSGMYLYRGACRECNFAGSNCAECIFNGEYQCLKCLENHVLVVSNGIFYCAKCPDIAHCLKCAYNSTRPSQFQCTLCDDPWLIDTVTGTCYMEDTSNMSTTVAVSCSVIGVGIVAVVVIAVIIKHRHHVCARMTHQNNLLDSAIDKSFH

SEQ ID NO: 276 - protein, 2165 aa, Giardia intestinalis
MLTGLVLSLALVGLRAHAQAASTITTAEEFNAIRNTPSGSYILGADIILDSSYVPIPSFTGSLDGANHKLTISGQTGSFGVFGDQFSGSVHSLKLSFTATISGSLSSPVGTLIGVSTGSATVDSVFVEGTMTLSNTGDASITVGGVIGSATETTTLRNITSEIAIACTGGSHSIGGIVGSSLVGCTECFYGGTISAGGAKASVVGGIFGTAGGVSLTNSAMYKGSLSTTSVATDQASALGALVGNITATGFTLQECYAEFTSISLTSSSAAYLGGLIGSFSLATSKDTVTISNSYVNGSTQTLSTTGGLSTSAGFLGYAASGKVTVTSSYVNLSRFAVSGSAQVNATLSVGTANQITGLTMENCYLSAQTVDLSGGTTKSSFSPIANVINVQSKGINVLELESRIGSLTLSSFTGLVSLAVSRFVTTTGGKLQDCFTSLDSCSLGSTPAGNTALFYAYVAGNAIATNIIANVSCAAITNADSGKSNASITYNYFNSGTAGPITSVAGKYIGLTDSDMRLPGSYIGIDTTVWNIDGSHYPHLKRTPHYRDGSYIIDDRAKWTADVWEIGQSMRLKRTNPPASCDSTNLQCSTTQYVDVSSCQCVEGCPGLVNGQCIGPNKAKCNPGFKLDQTNNCSIYSCITAIGGCPLADGSSGATCNTALDVCACADPNSYYDHTSKTCISGCTALVGGICTGSNEATCYPGWVADGNSLCAKYDCSTLTESDSNVCSGPSVATCDSTLKVCVCRDKTQYYDPSPANPRCITGCSAGVQYGVCSGSGQAVCIAHVTSVSGATSQDVLCTEYSCDTVSCGAQAECNSELKVCLCPLTSQYYDIEAHNCVAGCSSLAEGICVGQNRAKCRPGYSSQNGVLCGVYSCANDQSSRKCGGLGTCENGSCVCNQQAVLFRGSCKEGLCRNGNVVNGVCQCLAGWSSPTTDEQIEASGYCSIYTCPSTGTVIDLATPGSLMAIKACPSHSFRLTNDILARDYEWEGFDFSGSLDGNNHMISEINLRVSSSSSGCSASFFKQLTGQVRNVQLVFASSPVLDTVGQDSVCKFGLLSISTAASTVLENVIVSGSLSLQVPATVAAEIGGVFHTCPSSPTDVINSVTVTCAGANCTMGGYCHTVSAALTAGTSTATLKCQAVDGAVCIAGGFAYTVHAPISNIISAAQISLVPVSGEVTQAARVSVGGIAAVLAEGASASDCQFSGYITREQGDLNPAAIVHSGGAFYMVNGTSTAKVTIEGCTVTSDELSGIGMAGFVGTLINSTVRNCSAIATKIDGLRSASGFAQYVNDSVITNSFVKANVSITTEGRRMVGGFCGLASNAQISNTYAEIGNFSSPNTLTSSSIGGFVGRVENSVIRDSFVRANLLEATSLTSTSSQWTFGGFAGFIDQVGAGPMEIQRCFGDISNLSMSTVGSVYLGAFGGQIRKKSSTRATSKTISNVWINANVECTFSVPEDTSKKLANGVGMFAGKMYNGVALSLATINGSLVCRGANPPSMTTSQYYIGLFNGAKTSDTATSAEFVVINVTVSGVNGIGLKGAPDDKLVCSTCFANSDLLASTTRLSASTDPNLKTSEELRKMSTYSGFDIGTTGSKWTKSPGEFPFLNSLPALVPVDNKATYIYPACTQDCWDYTSFWVLSPSGPTTDDNKRHCADIANCMIYANNCMCSQCNLRYYFDGSACVACSSGCQTCRSADFCEICENGQVSNGVGVCIAPSCDFLYCGECSADNTACTTCSMRAFKAANGQCEKCGEGCKQCTGATACTSCGDGNYKPSPENGVCTCKDGFYSSESKCLQCNEACQTCTGGTAGDCTACSEGWTRDEATGTCTPQCAEVAGCLLCPNPPTCGTCRSDYILVNGQCVSSNTCMVANCLTCVTGNMNACASCKDGFYGSSCAACPERCSACDSSVRCTACKSGYALSSGGQCVTCSVSNCNQCSSDNTCSSCTDGYYLNVGQCSPCNKPCRTCVANADKCTSCQSGYELSANTCISTTACDVEHCRSCISPGVCGKCDTGYYVSSSRCSQCNSMCRECYGPNTCTECAANNAIPDENGICVSIVCNVSNCIRCDLDTLSVCTMCDSGYTLSSDNTCSLNTPPANKNSGMIAGVSVFVVIVVIAVVVVVVILFKKGVIGGKRSRRAPGMSSKYSGSMLSYNSLNESMNTPLL

SEQ ID NO: 277 - protein, 413 aa, Giardia intestinalis
MRVLILLLLHGIFSECTQDSDCGGATGVCNVTIGGKKYCSKCDGARVPVNGDCRLLSLSRGICIVPTGSNPTPGSCSGCIRDFLFYRGGCYRTASLINAICKEKHIVEEGMYCGACAIEGDVPIDGVCVPAGSAAGNTCSKGVCTTCTGGYFLHYGSCYKFDSSPGSIVCPNQSDTTGSVCGSCGSKFVKNPSASSSATSCLACYGLDGTLFCERCRMNVLTGADAKPTLCTQCQIGYVPVDGRCLSNYSALAALAGCSDPRGNGLCDACSSGFMLFYGSCYSVDGPLAQAICAAEDQIYVNGRVLCKRCAQPDHYPLNGVCIGQSSDGTDGHTCSGGSCTACSTKQTADGTPEFFLFYSGCYDITHPIGKSICSAVADGACTACASSDSSSVITITADGQSSKCLACWDDTV

SEQ ID NO: 278 - protein, 164 aa, Giardia intestinalis
MAAAVCSACDKTKKPNKDGSGCTLCAVGGCKSCAIDGMCEVCAEDNKKPNMAGSTCYVCPAQGCSHCSADNKCEACTNKDQRPSLDGTQCIVCDIERCMRCSAEGVCGECEEGYVPRDGMCVSSGTNRSGLSTGAIAGISVAVVVVVGGLVGFLCWWFICRGKA

SEQ ID NO: 279 - protein, 343 aa, Giardia intestinalis
MLIGLLLVCVVVRIHCTSELDKANHKTCTRVASVVDECPIKDCKACSEDKGTCTECEPGKHLTPTKKACLADCPAGTYLLEQACTPCDPSCAECGGAGASKCTACPAGKMLRYADEGKLNEGGQCVEGPECETCGLTIGGTKYCSKCKGSSVPLNGVCTSNAARAQFCTTAADGACTVCAAGYFIQGGGCYETTRQPGEQICALTDNKGKCQTCANGLGPDGAGTCPSCDPTCKTCSAANQENKCTTCATGYYKTALEGVCTSCESDSNGVTGVRNCLNCAPPSAGSGSVLCYLMKGGDSTGGSTNKSGLSTGAIAGISVAVVIVVGGLVGFLCWWFICRGKA

SEQ ID NO: 280 - protein, 719 aa, Giardia intestinalis
MFDKLILTIVVLQVVYAECQAQASGTGKCFTDRCDVTIDGETYCSQCAEKATEAPIDGVCKAVASDPSGCQSDNAGGCTQCGAGYFLHKGGCYQIGKAPGNLVCADSIPGPSARTAGICATCKDGYYKNPGDSPTADSCAACQDSNCATCEDATATNKCTKCMDGYFIGADANKGPCVSCGNAAGSGGWKGVAGCAKCKKPATSDTPAECIECSTEYLKTESSTQTSCVAEAACKEGNTYFPTTNGDKKLCVTCGDTATGGIEYCTKCSLVTDQGKAALITCLACGSSKKLSPGKTSCMDACPAHSNDKATPNICECDDGYTPDEAGTQCTGTPSPPPPSDCPVENCQKCSADKKTCEECKESAYLTPTKMCISDCAIIPGYYGANDNPKTCKPCEVTNCAACNMDGTCKTCKDGLYLSASSCQACNSSCKACSGPGEGDCIECKPKTILSYVDAEKGRCIPECTDTSTGPGSCKTCGLSVDGTKYCSACNVATEYPQDGVCKENTQRAGERCTTSHILSGVCTQCENGYFLMNGGCYKTDTYPGKTVCAQIEVTLGTCDNSAPGYYLSGGSLTVCSEGCAVCTTPDTCTRCMEGFVKLGSENTCTKCDASCKTCDAAVATCVECNTGYYKAAPGNGICISCENSSNGIIGIDNCISCKASSIPGPVLCYLMKDDGTGGSTNRDGLSTGAIAGIAVAVVIVVGGLVGFLCWWFVCRGKA

SEQ ID NO: 281 - protein, 410 aa, Giardia intestinalis
MLIAVLLICTTALAKSVPKTACNPAIDGCSTCETSPEGEQTCTGCTTDGQKVQPNGKGCIAKCPDNATEEGGICKCLATHQPSDNGLTCVPKTACNTPNCKACDNPKTDREVCTECNDGNYLTPTNQCVPDCTAIGGYYGDADKKCKKCSSECAECVGPASNQCSACPTGKALTYTNGEDPTQGGACGDACAADKNGCKACGAKIGGTDYCSQCSVDNQAPLNGNCATSSARVAFCTTMGAGVCTKCAANYFLQDGGCYEATRQPGKQICTLATNDGKCQTCANSLQPNNGVCPLCHSTCKTCSTADTANACTTCAAGYYMLGSAAGACTSCEADNGSVKGVKGCLSCAPPSTGSGSVLCYLTKDDGTGGSTNRSGLTTGAIAGIAVAVIIVVGGLVGFLCWWFLCRGKA

SEQ ID NO: 282 - protein, 565 aa, Giardia intestinalis
MGGCYSAASAPGNLMCKTAEGGKCTAPNENNKYFLVPGAASNQQSVMACENPLGTAVGEKAYVGVEGCDTCTAPAPLTEAGMRPARCTACNLGSGKPNLAGSGCFKCNIPTCSHCSANGVCEACTSEEQRPNTDGTKCISCNIDGCTRCSAENKCDQCGDGYRLEGETCVQIQPSACKTLGNAGCATCDPNGGDEICLTCTKESDFLQLNKKSCKASCDGDGEIADPTSTPKVCKCDAEKGYQLQDDACVQTQPSACQTENCQECTNRGKENEVCTECISTHYLTPTSQCVKDCTIISGYYGDADKKCKRCHDACAECVGAANNQCSACPAGRMLQYTNTNTPAYGGTCVGQCSVSATGEGCEVCGARIGGTDYCSKCKGSQVPINGVCAANPSARATACTSNGQGACTSCTGDYFLRDGGCYQTDRLPGKSICTQAANGQCNKCANDLVVSGGNCGECHPTCATCSAAGAADKCKTCVTGYYKTSDNEGSCRKCSEGLVGCRQCIASANAFVCLEMSDNTSENVNKSGLSTGAIAGITAAAVIVVGGLVSFLCWWFIYRGKART

SEQ ID NO: 283 - protein, 836 aa, Giardia intestinalis
MLLKITLTCAIALAACQEGAESTNCKEGSCTVKIGGDSPENTYCSQCATEGEAPINGACAVDNGFCTANNAGVCTECATTVNIFMYKGGCYTTSEAPGQTICTAADSGKCTSAGTGYFIIPAEDTDASHQSVVSCGDAEGAAVNNDKTYKGVKDCVKCNAPGPIQSPSGTAAATCTECGNNKIVKTDTSGTSCVEESACSGGFFVSGQKEAQSKDKKCIACSAETYGVADCNECSPRTDDPTKAGCTACSGSKKPNAAGDHCYTCEGSGDTKDCATCSSDNVCETCIPGKILRIDAAKTCIAEAECTGGFFVSTDGSGGKTCIKCTDQTNGVTECAVCEARTDDRAKAKCLACSGENKKPNVTGDQCYDCSVPNCEKCKAPDQCEACSTGEPLETGQCSEVRTECHESCSTCLEGAMNNEPEKCTGCKDLKYLKIEDSGKGSGTCVPKGSCGADHFEVETDRKCYPCNAVDNGGVDGCAACTPRASTRDARAVLIACSACTDTRRPNTDGTRCIPCSVDGCGNCNEENVCAKCASGRRLTPTRECVDKCGKLEGYFDGDDGTCKACSSVCKACSGEDPHQCTSCPARKVLKYTVEGALEHGGTCVDECTINTNGCAECGATIGEARYCSKCSDPTQAPLNGNCTASARAADQCEKVVDGACAKCKEGSFLFEGGCYETARQPGMQICKDAAGSDGKCKTCANTLPPSADTGACPSCPAGCATCTAAGQTHACQTCLAGYYLDSDRHLCTKCTESSGGIHGVADCASCDPPVGSSGPVTCYVKRDGTGGGDSGSGGGSANKSGLSTGAIAGISVAAIVVVGGLVGFLCWWFICRGRA

SEQ ID NO: 284 - protein, 387 aa, Giardia intestinalis
MIGSKQICTQCNQGNVPIDGVCKQKDNEAVTAADCKKSEGTGLAESDKVCGKCGAGYFLYKGGCYKIGGEVGSLICADTSSPGVRATAGVCEDCKSGYFKNPEAAANADSCISCGDQAGFTITGGSGNTYKGVQNCATCQAPAGPGAVRATHTAVCESCQEGFLVDNNGAACTQCSDNTNCAKCDAGADKCTKCKATATNKYFKDSGDGTGTCVNEGGCNDNTHFTDDAEDPTHGKMCRKCSEGIADCKTCAPPSPAALTTTSTIVCTECTTATNKPNVAGTGCFTCSIDGCDNCSENGICEKCGPSKKVSPGKSSCIEKCPENSTENSNACVCNSGYGPDSAGTGCVTVSTNLSTGAIAGISVAAIVVVGGLVGFLCWWFICRGKA

SEQ ID NO: 285 - protein, 810 aa, Giardia intestinalis
MLATLLLLFLVSSYGASTDTYHNNFGVACDNAQENCMQNRCVVIESTSVCTQCIPGYVPISGTCTEYPGSASSICIPDSTTSPTRCVECKDSASEASMFLFYGGCYDMIDESIGSSVCSKASSGKCTECNVGVGGRYVFTNPDGSTAEGCILCSDRVGFGGYRGVAGCLECIQPVDQRLGTPLCFECDSTTLAPIDYQCQDKGHHICSDGRCTSCYKTHLFYNGGCYGRHTTTGLAICAGPNQYELDNTTICTECANASYAPKNGACTLVKKDSTTGGLFLDCAKDPARGLCTACSSSTPSFLFYGGCYDTSSYVGSILCSRIGSNACEEWNGQYPFIFPEDTAKRDHYLCGDAANGGVASCATCSYASSAVICTSCSAGYLGVDGKSCNESCSGNTQGACIEILGGSESTILLCQCICKLGFYNNSGICMPCTDSCAACKDGTPNGCQQCSPGKVLESSVITSGNAKCIDECTTHGSCVECGLTIDGSKYCTRCKDPSMYPLNGVCTTDAQRTSYCTTKANGICSACSEAAFLMNGGCYTTVHYPGDIICISQADGKCTATREGYGISADGKLQPCAPECLECTAPGLGRCTKCPPGRLLRRASAAATGSCIEPGACADGYYADGDACLPCVVPGCRACGRTSFCTECAGELFVGLDGRACLRECSGDRVVGEVSGGTRRCWCERGFVLALDRSGCVPTAECPPGVPWCASCDESGRCLSCAAPGHNIQVDQRTCAEGCGDRAAPDQGVCVCETGTVLDKDACVPINALTGRKMMVVTTSAAAAVLVIGVLAGFLCWWFICRGKRRCYR

SEQ ID NO: 286 - protein, 408 aa, Giardia intestinalis
MLIAVLLIYTTALAKSVPKTACDPAIPGCSTCETPPGGEQTCTGCTDGGQKVRPDRKGCIDECPADSNEREGICTCAETHQPSGDGLTCVLKAACNTPNCKACDNPKTDKEVCTECNGGNYLTPTNQCVPDCTAIGGYHGDADKKCKKCNSECAECVGPASNQCSACPTGKALTYTNGEDPTQGGACGDACTVDKNGCKACGAKIGGTDYCSQCSVGTQAPLNGVCTANARAQFCAQVTEGSCTSCSGGYFLKNGGCYQADRQPGKQICTLADSKGGCETCANGLPPSSSDVCPSCHPTCKTCSVASNPDKCTSCAAGYYMVGLNDGTCTSCERDSGNVKGVSGCLSCDPPSNSQGTVLCYLTKDDSTGGSTNRSGLSMGAIAGISVAVVIVVGGLVGFLCWWFLCRG

SEQ ID NO: 287 - protein, 255 aa, Giardia intestinalis
MLLIVFCFVLGTLAVQHAESHHSEYLSSNSQSDGDVGTRGNVYAAGNCEGGMEEQVGAETVCKQCTAGFVPINGVCAAQNTPSVGTAGCKLANGDSPGLDSTVCEQCGTDATYFLYKGGCYDASTGVGKSLCKRASSGACAEAGEGYFAAPSAKATEQSVVSCSDTTGVTLAGDKQYVGVANCATCSAPTEDERVAKCKTCNDKFSLEDNQCVPSSTNKSGLTTGAIAGISVAVVIVVGGLVGFLCWWFLCRGKA

SEQ ID NO: 288 - protein, 654 aa, Giardia intestinalis
MFEKVLFASLILQVTQAVAKTCTEASDSSQTGQCKKGKCISIGEDSVCTDCAKPGEVPINGECKDKTDGLITTAGCEKADGALDEQSTTCEKCTKTGYFLHKGGCYAQATPPGQTICKSAGSSAGLCETCNDVNGFFKNAGASDNTHQSCIACNEAEAVDGFRGIPNCKVCTSPVSPGYAICTGCEGDYYLLAGSPIICITEVQCKADSDHFPTTVEGIKKCIACGDAEAGGIADCETCALKEARMAEAPVVTCNKCAGEKVPDGDGSACVNAPEPSPSDCLIENCQKCSADNQTCEECKDMNYLTPTRMCVSDCATIPGYYGADGKPRTCKPCEITDCATCNPQGQCETCKDGYYKNGAACTKCDDSCKTCANGEPNGCTSCGSSKALKYEGAGNTGTCGEGCKPVSGGTDGTCKTCGLSIDGTSYCSVCNTDKEYPESGVCVKRSARTTSCQAEPSGGVCGTCAKGFFRIDGGCYETAKFPGKSVCADANADADTCKTPVPGYKIEAGKLVTCSEGCDTCSDANTCTKCKDGYVLITSKCTPCSAGCATCTGTAAGCSTCSTGYYKSGPKCIACDKDDSAIKGISNCLNCAPPSTGSGSVLCYLTKDDSTGGSTNRSGLSTGAIAGIAVAAVVVVGGLVGFLCWWFLCRGKA

SEQ ID NO: 289 - protein, 740 aa, Giardia intestinalis
MLCLLAFGLTGSFVIDPYQNAFEKECTTAAQKNACATKKCITVSGTELCRECISGKVPIDGICKDTTDPDVSLYGCEHTTGYCTLCKSPAFLFYGGCYAISKTPGSLICSNIESGKCTKCRQESRFLFTNPNNDAAERCILCYDNVGFSSYKGVDGCMYCLPPLAEETSAECNWCQNKKYGPIDGVCTDPGKHSCADGACSNCYMTHIQHNGGCYEKTGAVAQKICVTQNQFQVTNITACKKCVITGEAPMDGRCINVKFNSKCNPYPNTTGSCTDCKRDGVNDDTFLFNNGCYNISDYIGSQLCSKVGENAECELWNIGSYAVFRPPNDRNAYTCSDTSARGIPGCSRCHYDVEKKRPICYNCEHETLAFDRMSCTTETGCTGENIQRKCPGNSERGCRCECAEKSYKNGNKCVACDSSCLKCSGTENRSCTLCPPGKALKYAGSSMAGTCEDGCKQDDTCETCGLTVNQTAYCSKCKNSAQYPLDGVCTSTGEARTSACLQQSNGACQKCSSDYFLMGGGCYQINKYPGRFVCGWADDGKCVETMNGYSINDQGQLVDCDSNCMTCVEGKKEQCLSCRTNKYLKKEGTNSYGTCVSRNACKDGYYANHDTMECLPCNINDCVSCHLIDKSILCSRCHGDNLVSLDKLSCTTVIPENAVEFWGGYTCNDDSVLSGNTCLKKSSQSNKGSGLSNNVTIGIGIGAVVIMGTLIGILTWWVVSQKKKGANSERSRSLVISKS

SEQ ID NO: 290 - protein, 514 aa, Giardia intestinalis
MFAKLIFISLILQLTEATRPAGRTRSEGECTSLGAAGCATCSTGDSGETCLTCTDPEKFIAANKKSCEDACNTSGGEVVDSAAVGPDGSPIKACKCDTEKGYQLQGDACVQAPPDGACSTLKPAGCATCSTGDSGETCLTCTDPEKFIAANKKSCEDACNTSGGEVVDSAAVGPDGSPIKACKCDTEKGYQLQGDACVKTQPSACKTENCQECTNKGAADEVCTKCNPTHYLTPTNQCVSDCTTIKGYYGDTDGKCKACNPECAECVGAANNQCSACPAGKSLAYSNSMYPNNGGTCGDACTVDKNGCKVCGAKIGGTDYCSQCSDATQAPLNGNCTANTRAAFCTKMGTGACTQCADGYFLKDGGCYQTDRQPGKQVCSSAQGGNGKCRTCANGLAASDGNCGECHPTCATCSAAGAAEKCRTCATGYYKENADSSADGTCKRCSEKIPGCKQCTSSSAGSVVCLESEAGTGGSTNKSGLSTGAIAGIAVAVIIVVGGLVGFLCWWFLCRGKA

SEQ ID NO: 291 - protein, 1299 aa, Giardia intestinalis
MMSFFVALLPALFRCGRCGSTVPRCLDCLDLDNNYCCRCQGDFLPVNGLCLGGDASMPCASYLDGTCTGCLPGYLLVHDGGQMGACIACSHVVLKLGPGCKDCTLVNGVPHCLACHSNYFGISVPSHSGATLLQCTTLSKRKMSLWSQRKDLFVLPGQAACTVQNCRACTSRAPNICVQCTRGYSLTDEGRTCVCGVPHCTTCSPTDGQQCTQCDTNYALTLHRACVCSVRYCVQCSSQGPARCQKCITGYRLSEDGSTCNCGVDNCAFCSPTDGAHCVTCVAGYVQSYSQRSCTCAVENCAECFPADGSQCVRCVANYAISHDFKVCESSPENCLYPSPFNGSICSICNSGYVTAFSGEVCLSVKCQVLYCEECDGVLCAQCRKGYSLVNDGLGCACNALNCLICNPDDGNLCLKCLGGYDITPDGLCECTIRNCATCSQDGRSCKACVNGYRQGESGCECLIGTCKTCNPQDGQLCDECHLNYDLVHGTCVGKLPGCLFASFIYEGVCELCNENWELFHGRCFCKIRNCNKCYEDGKVCIQCAKGFTLQTGNTECACTLTNCAECDPKDGTKCLACNTGYTLDSSGQCTTGTCSIDNCKTCDQSGVCTECNDNYELSTDGRTCTCMLSNCSRCRPSNGQQCLECVTGYKLDSSMNQCICDVHLCETCNSSNGARCDTCIAGFIKGPTGTTCSCAVDNCRVCSLSDGTKCEICNLGYVLAGNACQPNIANCEQYSLSRGCVECVSGYSLMPSNLECLCTVQNCETCSPTNGSECTSCVKNYMLQENLCLCRVQDCLQCDNTDGYLCSVCTHNYVLSEDRMTCACGIENCMECAIKDGKKCFMCEEGYRLTETDACEEIPCNVENCLSCPPDNPNYCIVCLRGYWPVNNGSMCACSDPACIECDIEDGAVCFECNANYKMFNNKCICSLPYCIKCDTNDGSQCEQCERGFVLTSAKACILRVCFTNQDNCKVCGTGAHANKCLTCIDGYVPIDGVCVQDSKQDICNQRSGMCTSCVPTYFLWQNGCYPCDMIPNCIECYMSSTYGPLCMICEPFYTLRGGKCQLNPYCSRGCECNDSLQCIDCIAGYTMVNNVCALCEDLFYMCAECSKTFCTRCFDGYSISNHDCVLGKCEENAHGCLVCANDYTCARCRDGMYLYRGACRECNFAGSNCADCTFDKEYKCLRCLGGYTQVVSNGVPYCVKCPDIDHCLECTYNGTRSLQFQCTVCADPWLVDTATGTCFTRKTSNASTITTLSCSVIGAAIAITVTIALIVKCQHYRHARTARQVGSLVMEVDEPGH

SEQ ID NO: 292 - protein, 579 aa, Giardia intestinalis
MLLVAFCFVLSIFAADCKSDGSQYSVCTNGKCEMISETEICTECKVGGNVPINGVCTSKDNVADKCKKASDEVLTEDDKICGKCEGSTFMYKGGCYDKEGELGRAICKTSGATPGVCDECQEGYFKNADNLATTDSCSPCKDAHCAECKDASTTEKCTRCMEGYFIAKNTAEGPCISCSADSPTNSYQGVPGCAKCEKPVSPGPVKCTKCVNDYLKIDAEATTCVKESECTKGFFATIVDGIKKCLKCNDVYSGITGCSECLLLPSASRANKVLIKCIACETDKLSPLGDACLVSCPAGTYAVSGDSGSVCTPCHKSCANCKTNDAETSCTACYPGYSLLYGSDGSADTGKCIKECTGEFGANCADGQCTADVGGAKYCAQCKDGYAPIDGVCTAVTAGRDASMCTAAGGKCTACKGSYALISGGCYGTQKLPGSAVCTAARDGKCSACGNGETQKDGVCPACPTGCSKCAAGSSPQQCSECLPGYYKSKTKCVACNKDDEADIKGVPNCVSCKEPAGSGTVTCYLTQEKTDDSTGGSTNQSNGGLTTGAIAGIAVAVVIVVGGLVGFLCWWFLCRGKA

SEQ ID NO: 293 - protein, 421 aa, Giardia intestinalis
MFAKLIFISLILQLTEATRPAGRTRSSGACTSLGDAGCATCNPNDGDELCLTCTNEEEFIQLDKKGCTAACAGEGVIGDSVANPKVCKCNEGSGYKPQGGKCVKDSEGECKAENCQECTNKGTANEVCTKCISTHYLTPTNQCVPDCTVIEGYYNDRAANRCEKCNSNCKTCLAADGDKCTSCPAGRALTYEAGDPTRGGTCGDACKVSADGAGCETCGAQIGGTAYCSKCKNTQQAPLDGNCAANARTRFCNTVSNGACTQCADGYFLKDGGCYQTDRQPGKQVCSSAQGGNGKCRTCANGLAASDGNCGECHPTCATCSAAGAAEKCRTCATGYYKENADSSADGTCKRCSEKIPGCKQCTLSSAGSVICLESEAGTGGSTNKSGLSTGAIAGIAVAVVIVVGGLVGFLCWWFLCRGKA

SEQ ID NO: 294 - protein, 674 aa, Giardia intestinalis
MLLIALLFVSNTFAADCQPDGDHAATCQTGKCEAVGSSEICTQCRAGGAPIDGFCRPVGSPQVIAAGCTKGDGSALEGTATTCGKCGSGYFLFMGGCYRTGSQPGSEICTAAEGGKCTVCNTANGLFKNPAAAPDAGRECLFCWDTAEINGITGVVGCSECSHIGTSGPVTCSACNERYFLDGARHTCTQCINNCETCTGAGATNCKTCKAGFYLKDGNTCVAEGSCTDTAYPDLESGICKACTTIHEQCTACSFDKANGRPKCTACGGSQILKTELDGTVTCVVEGQCAAEKTHFVIDESGKKCVPCSDVTTGSTDEKQGVANCRTCTSSPSQKPICETCLDGYYGTTSCTECDANCATCNSAGAAQCQTCKPGYFLKGGQAPAECVACDSTTDSGISGCAICTFDTSLTCNSCKPDYALIGSGCQKSCEDDTGCGGASGACDATIIDGQGNAKHYCSYCGKTNDVPIDGRCVANTQNQGNTGCTDHVCTQCTTGYFLYMGGCYSVSTAPSSHMCKTADGGVCTEAASDKYFAVPGAAKTGQSVLACGNPLGTAVDDKTYVGVEGCSQCTAPAQLDAPGMASATCTACGEGRKPSKSGTGCAACSDANCRHCRVDGVCEECSSGFSLEGGKCVSTGGPNLSTEAIAGISVAAIVVVGGLVGFLCWWFLCRGKA

SEQ ID NO: 295 - protein, 1062 aa, Giardia intestinalis
MCTGSMHLYKGGCYSCGNFYPGNLICKECDKGVCTSCTSNFFKNPAASQTVDSCIRCNDTTGVSGYVGVTDCLRCSLPSNSKVAKCRACKLSTHKPNLEGNACYRCRTPDCYRCKADNVCEVCGNFKYLQGTTRPYCVSSCGAGFYSVSVPSLQCKKCSATCRACEGPTELDCTACRESENYFLTATNGAGKCISCGDERGYAGWMGIANCKTCYPPNGPGVATCNTCERGYSLVDGKCKADCDDSSGQCAANSCHVTIGDKSFCSLCNAGYAPVDGICKNAQSDLPSGCVADNGQCNKCGAGYFLYYGGCYSGSTETHKTICLEVGTEPDRVGLCNKCADGFQNKDGVCILCWDSDCKTCSKDAAKCEVCRDGFYDPEFCRHCYKSCETCIGEGSKQCLTCPSNQYLRPIYDNAGMCVESTECGYGMYGDSSSHKCVPCSAGCSTCEGAGDDKCTSCPIRTHFLDGSSNGAGRCIECGNTTNSKGIDGCRECTMEGDSVKCLACKAGYTLVDGKCQSNCQDPNCAADSCVVGISEKLYCRLCKTDGHAPIDGVCTEVSGAHPSGCVTGVAPDSARSCLQCGAGYFLYMGGCYQENKEPGKSVCTWVGVLGPINKNNYGLGLCNACAPGYENQNGICHPCATVNCEQCQTEDQKEVCTHCMVGYVMDQTGRCSTQTTGSCAVPGCAVCANDGRCQSCGPRSFLTGAGTCVNNCRDIPGHYALDATGEGPARCALCEVRNCKECGASDSCAVCADGYFSDNGACAPCDSKCATCMARGPDGCTSCPPGYAITSESRVGRCERPCTPSAEGCKACDASIDGASYCSVCSVQTAFPLNGQCVGPSARAEPACASVVDGVCKKCADGYFLLSGGCYQVETYPGRAVCRAEEQGVCTRGAHGKIVSASGVLRECSVANCAECTADACVTCRVGYVHVNGQCQRCAPGCVACTAPDNPQMCTLCDTGYYQSTTGSVFTCTACSAGNNGMTGVSKCTYCVPPEGKAGSVLCYSFGTSPNITPTPEPGPAPDPSSARKTALIAGASVAGVLLITGLVGFLLWWFLCRSIR

SEQ ID NO: 296 - protein, 714 aa, Giardia intestinalis
MFEKVLFASLILQVAQACTAEPSGGDGTCHTCEAPIGQTNYCSKCNGANHAPVNGQCTDVSQDKTICAENGEGKCTRCAGTAFKYNDGCYQASEGKPGFNLCVLAASGVCTEGAPGYFVPTGAVNTEQSVIACSDTTGVAIAANGGNKYKGVADCAECSAPDAAPGAGADKIATCTKCGAGKYLKDNGCIDKAQCDPDSTNRFVAVDDPGNGNRCVSCSDNSNGGVTNCDTCAYDEQSKKIKCTKCAGSNYLKATGEGTSCVQKDHCKDGFFPKDDSGAGNKCLPCNDGTDGIPDCTACALVNGRSGAVLITCTACAAGYKPSADKTTCEAVTNCKTPGCQTCNNEGKENEVCTECASGAYLTPTSQCIDSCDKLGNYYGATEGAKQTCKECAVPNCKTCNNQGQCQICKDGSYKNGDTCSPCHESCKTCSAGTANDCTACPTGRALKYGGDGAKGTCGDGCTTGQGSGACKTCGLTIDGASYCSECAVDTEYPQNGVCAPKANRATPTCSDSPIQNGVCGTCANNYFKMNGGCYEIAKYPGKAVCTATQAGGTCKTAADGYKLDSGTLTVCSEGCKECASGTECTTCMDRYVKSTKICTKCDSSCETCNGAATTCKVCAIGYYKTASEEGVCTSCESDSNGVTGVKGCLNCVPPSGNTGPVLCYLMKDDGTGGSTNRGGLSTGAIAGIAVAVVVVVGGLVGFLCWWFLCRGKA

SEQ ID NO: 297 - protein, 684 aa, Giardia intestinalis
MLSIAFCFTMTTLAAPCDPEGNHMAACAHEQCEAIGIYEVCTQCRAGGVPIDGFCRPIGSPQVITAGCTKKDGADLDSTATTCGKCGSEYFLFMGGCYKTGQEPGSDVCTTATEGRCTICNTDSKYVFQNGASQATPGGECVLCSDAKGKDGFLGVENCAQCTKTGAEAGTATCEACQTGYNKNSNTCEKCDDTCLTCTGTGATHCSSCRPGTYLKSDNSCSGNCEGGQYADPESQTCKACSAITDCTACKYNATVSKPQCTACGSGKKVKTAIDGATTCVTVASECVDSDHFKDDGDTMCVLCSDVSGSDPNKGIAQCKTCSKDGANKPECKACLDGYVLRGAGDTATCESCENNCAVCTTAGDMKTCTKCMPGYFLQLDGELKECIPCSEISKGGREGCSVCSNTGGFKCTNCKANYQKEGEADNCTCRKTCEDETACGGTAGACDAIVIDAEGKALNYCSYCGGADDVPINGLCVNNGNKAGNTCANGVCTQCAAGYFLYMGGCYDVTKTPGNLMCKAAGQEGICTEAASDKYFVVPGVTSNTEQSVLACANPLGTLAVGNAYVGVEDCSQCAAPDARSDGGMAVATCTACGEGRKPNKSGTGCAACSIENCRHCRVDDVCEECSSGFSLEGGKCISTGTSGGNRSGLSTGAIAGIAVAVVVVVGGLVGFLCWWFICRGKA

SEQ ID NO: 298 - protein, 652 aa, Giardia intestinalis
MFNRVIVVSFILQFVWTASEAETCTEAGEGTTAKCLTGKCDVWINSKKYCSQCAKTDEYLINGECNANVGASGCQIKARAADGTCTQCGDGYFLYKNGCYAIGGTPGNEICADTLPSDPSGTAGKCQNCAPGYFNNPAADAAGTPPCIACNDTSGFTDASDGNKVYKGIKDCAVCSPPNVLAAAREDKVAVCESCIEGNYVENNGATCTACTDANCAKCRTAGQKQCIECKATGNEIYLKKEDGTEMGVCVTDVACKTQDTHFPTTDANQKKICTPCNDKAIGGVDGCQTCTLKDNPESSILITCSTCTVDTNKPNIDGTKCVPCDIQDCIKCNEENMCEECTGGKSIGSLRNECMEGCPAGTRDVDGMCTSCHTSCAECDGDSETSCTACYPGAVLDRMVTNGHTGACIPECTGKYAENCEANQCTAVVGGSKYCSRCKSGYVPVDGLCVLVETATRASPTGCTPSENNDGTCKACTATYFLQSGGCYQSAAYPGSKLCGNAQDGKCTNCANEQKPEDSTGSCPACASGCKTCDAASKETCKTCLPGYYLAGAKCVKCDTDDPNGGSHIVGVPNCISCAAPASPSPGASTPVTCYVKTDGTSGGGGSSGGGSTNKSGLSTGAIAGISVAVVVVVGGLVGFLCWWFLCRGKA

SEQ ID NO: 299 - protein, 678 aa, Giardia intestinalis
MLLIALLFVSSTLAADCQPDGDHAATCQTGRCETVGSSEICTQCRAGGAPIDGFCRPVGSPQVITAGCTKGDGTALEQTAATCEKCGSEYFLFMGGCYRTESQPGSEICTAAEGGKCTACKTDSGLFKNPAVTVSLGSECVLCSDTTERDGITGVKDCAQCTHTSTSGAATCTTCKAGAFSKGTTCEKCSNSCLTCETEATRCTSCPEGKYLKATTCVDISGCDGATYADPESQTCKECNTITDCTACKYNATVSKPQCTACGSGKKVKTAIDGATTCVTVASECVDDYHFKADNDAECTLCSNTTAGSTANDKGIANCNKCAKANSGQTPKCSECENGFFFDRSSCTKKCADNCATCSAETAEDKCLTCKAGFFLVEATKPAGRCIPCDSTQNGGISGCAECTGTAGSLKCTQCKPDHAPIELGCQRSCEDVTGCGGTAGACDAAVVDGSGNTKHYCSFCGESSKFPIDGICTDTQGSNTGCTNHICSYCAQGYFLYMGGCYSTATPPGNLMCKTANSGICTEAASDKYFAVSGAAKTDQSVLACGNPLGTAVGEKTYVGVEGCSQCTAPAQLEASGMASATCTACGEGKKPNKSGTGCAVCSVENCRHCRVDGVCEECSSGFSLEGGKCISTGTSGGNRSGLSTGAIAGIAVAVVVVVVGGLVGFLCWWFICRGKA

SEQ ID NO: 300 - protein, 635 aa, Giardia intestinalis
MLSAPWIASSMFDRIFFGIIILQLVWTAEATEKSPAVTCDEDKTGGQVSKKCKQNMCTVWIGGSNFCSQCSTEAEHLVNGRCVTADEDTDNKCTAKNDGTCTSCKAGFFLHRGGCYEIGSDIGLLVCDDKTATVNKDGICVACHEGYFKNPASDADSSKESCIACNNTAGADYNKGVQNCATCDAPETPGQDSAEQTVTCKSCMDGYYGTANCQQCHADCKTCTGSGEDKCTSCKDTDKQYFKEGASSDGTGTCVAENGCGDTHFPVAEDKKCYPCGSVNKGGITDCKTCSKTGATVKCLTCENNKKPNEAGTSCFECPMEHCEKCSKDSTCEACGSEKKLSPKKDLCLDACPAGTYTNTNNCNLCHESCAECYGDTEATSCTACYPGYVLTYGNDKIKGKCVLECTEDLTIHCIAGQCDGIIGGSRYCKKCEDGYAPIDGICTAVGEAVVRSADVCKAQSGVCTECKGDYALLSGGCYNTKQLPGKLVCTAATDGSCTTCANGQSQSGGKCPECPANCEKCSNPSTCTKCLPGYYKGANSNCFKCIEDDSNSSNRIIGIASCISCDPPASGSGPVICYVTQQKTDDNTGDNTGGSTNKSGLSTGAIAGISVAAIVVVGGLVGFLCWWFLCRGKA

SEQ ID NO: 301 - protein, 1089 aa, Giardia intestinalis
MCTDSMHLYKGGCYSCDGIDPGNLICKECDRGICTACTYGFFKNPAASQTVDSCIRCDDTTGVSGFMGVVGCQQCWPPDLKQSNTARCTACQLATHKPNTKGDACYKCEITDCFKCKADDACEVCGNFKHLKGVDKPYCVSECGIGFYPAPTPLRQCEKCFAICHTCEGPAETDCTSCHGPENYFLAGKNGVGKCISCGDEDGYAGWSGVANCRSCAPPSDPGVVKCYACEQGYSPIDGECEAECGDYSDECTIESCNVAMSDELVCSRCNEGYAPVNGICTEISPDHPSGCVADKGRCEKCGLWYFLHQGGCYDVWLRDNNFICLEVEAKPEQIGLCKKCASGFQNNKGICVRCRDPYCKTCTQDTNICESCLDGYHDPSFCRRCHDNCKTCVGEGPERCLTCPSGKYLSPIYKNIGVCVDASQCGYGMYGDPYSHKCTSCSAGCATCKNSEEDKCTSCYIRTHFLVTAKYGRGQCIECGDVTNPRGIDGCRECTMEGDSVKCLACKAGYTLVDGKCQSNCQDPNCAADSCVVGISEKLYCRLCKTDGHAPIDGVCTEVSGAHPSGCVTGVAPDSARSCLQCGAGYFLYMGGCYRENEEPGKSVCSWAGVIGYASNSNYGLGLCNACAPGYENQNGICRPCVTVNCGRCQMEDQGEVCTHCMVGYVMDQAGRCSIQATGSCTVPDCAVCADDGKCQSCGPGFFLTSAGTCVNSCRDIPGHYALDATGESPARCALCEIQNCKECRASDSCAVCADGYFSDNGACALCDSKCATCMARDPDGCTSCPPGYAITSESRVGRCERPCTPSAEGCKACDASIDGASYCSVCSVQTAFPLNGQCVGLSARAGPACASVVDGACKKCADGYFLLSGGCYQVETYPGRAVCRAEEQGVCTRGAHGKIVSASGVLRECSVANCAECTADACVTCRVGYVHVNGQCQRCAPGCVACTAPDNPQMCTLCDTGYYQSTTGSAFTCTACSAGNNGMTGVSGCTYCVPPEGKAGSVLCYSFDALPSITPTPEPGPAPDPGSARKTALIAGASVAAVLLVGSVIGFLLWWLLRRRTQPHGTKRVTLNRKRVPTTTSITAPLT

SEQ ID NO: 302 - protein, 691 aa, Giardia intestinalis
MALTVAQQPADPMFGRFVLVGSIVQLAWAAQAAGKAEPAACADETGKCATCDVLIGDKLYCSTCKAEATNHAPVNGVCKDVSSDTAVCKTNAGGKCTECNGQSFMYKDGCYSKDTAPGNTMCSQAAEGKCSAPDNKKNYFVVPEAERKPTEQSVVWCGDPMGVTLKSGQTYKGVDGCTTCEGSPLQAGASGIAVCNACGRDESGAERIVRTATDQATSCVTEAQCIAEEGFFVNTVAGKKCSACEDENCAVCMATGNGKCTRCKDTDKKYLKKGDQSETGTCVTEAECKSGDTHFTDDTGISANGALCRKCAEGGLKDCDKCEKPAGELVCKECTGQKFGLSKKSCVAECPASSAERSGVCTCDDGFEPDSTFTSCQPKSSCRTLGCKTCTGEGTDKEVCTACFEGKYLTPTNQCVPDCTVIEGYYNDRTANRCEKCNSNCKTCLAADGDKCTSCPAGRALTYEAGDPTRGGTCGDACKVSADGTGCETCGAQIGGTAYCSKCKDTQQAPLDGNCAANARVAFCAIVTGGACTKCNEGYFLKDGGCYQTDRQPGKQVCSSTVGGKCTKCASGIDATDGDCSTRKCHESCETCTTANDPNACTTCNTGYYRPQNVGTKCNPCSEGLTGCRQCTASSNAFMCLEMGDSTVDGESTNKSGLSTGAIAGIAVAVVIVIGGLIGFLCWWFICRGKA

SEQ ID NO: 303 - protein, 235 aa, Giardia intestinalis
MLLVAIYLSLGVLAANCSGSTAAANCEAESCETVNNIQICTQCVAGYVPIDGKCVGFATANNCKTAANAAVGAGDKTCGQCTGASFLYMGGCYAVGADGLGKTLCKRAADGACKEGADGYFALLGATPTELSILPCNETTETTLAGDKKYKGVKYCATCTAPEAASGGEIKIATCQTCTDKSKPKDNVCPSPENPNINKNSLPPGAIAGIAVAVVIVVGGLVGFLCWWFICRGKA

SEQ ID NO: 304 - protein, 768 aa, Giardia intestinalis
MMQTLLPLTVACLLVGVFSEEASIYRNGFGYSCNDKVPKCLPNKCITDIILQFLCTECESEYVPINGRCVLTTNETVSKAGCAGSSQGGWCTKCGDDHFLFYGGCYDSSLEWTKIICERAEKGLCTKCANNGYRLTLVFTNPNTTAPERCIYCGDPIGFGGYSGVYNCQNCRQPRLPGTTEADCYGCLQQEMCSFDYRCKPAGDIASFGYCTICPKTHVWSDFACYAIGGATGDSVCLLENIIEIQNRSLCTRCTNPLEAPQNGRCLSISKFDNVCVKDPEKGQCTSCQDRDAEKYFLFYGGCLRKDTSYQIGSQICQEVRDNVCTMCNSSTEEVFTGNNRCWRCGDSANGGIDGCQRCKVGSDGLQCLECRDLYLSLDKKSCLAGCPRGQRGVRDPSSSVHSCTCDDGLYLKDGGCVRCTVENCAECDEAKCSKCRYGYTLSDSRCAETKCKDPNCDACENRDVCTRCSNNYSLDQNGLCVKDCLSSAGYYKATVGDVSRCVACTLGGCAVCESADKCTTCRDGFYLESQGRCKPCSSACATCSGSEAGDCTSCPAERRLQYSDGTKGSCVSQCVQDGSCAACGLTIDGTSYCSQCVKSTEYPRNGVCAPTSSRATGITCTNAFGGQCITCGPSSFRLSGGCYTSRLLPGKAVCTTESDGWCDTTVAGYEITHNGALRACPKNCAVCGGGVCSACNSGFYPERGACRACSKGCATCPHGRACFDCLAGYYFSGSTCKACHKAVPTVQPVCGAGGRDAACVPGVRPCL

SEQ ID NO: 305 - protein, 475 aa, Giardia intestinalis
MCITALVIWMTLLHPDYCCEQSSVDRRYVLLIYYTLAIYISIQKVHSVIIFSMFGRLLLLGFVLQLTHAEGECTPIPSGSPDTCKVCEAVIDGVNYCSQCNDDRSDPSSGAPTDGVCTTDNNECSQKANGKCTQCAHSSFMYKGGCYKDSQAPGNTMCQATDSNGVCTRAKDGYFVPPGADASHQSVIPCGDEEVVTIGSSKQYRGIPNCLTCTAPVNGDGADSTPKAPTCNACKGGFFVDASKESTCTACPANCLTCADGTAERCKSCTAETHFLGATDGQEGKCVSCGTVQDAWSGVANCAKCSKPTGERVPAICKECADGFYLKTGEPPSCAIIEECTGGFFSTTDNTGKRVCTTCGDTANGGITECSECAPTSQTAKTDTVAITCSKCNKGKVSPGRTSCIDACPENSTENPTGTCVCNSGYSPDEAGTSCVAVSTNLSTGAIAGIAVAVVVVVGGLVGFLCWWFLCQGKA

SEQ ID NO: 306 - protein, 2537 aa, Giardia intestinalis
MILFLELIGVTLSICVQAVDSNRGAGTCAENNCKVLDEQYCAECATPGEVPINGVCIPLTDPRAVASGCEGNTGAPLGTSARKCEFCRGGNYFLHEGGCYSVLYNPGNRICRTAASGYCTLCVDGFFLGTTSSTNQCKPCESTCATCKDGTAQSCLSCRSDRFLKNNECKECSAADSGIENCAQCSQESSVVTCTLCKEKYFIKEGKCTACADNCATCTSARPEDCSVCVSKYSYDLTAKKCTQTCDEHDSQATKCKTNKCTALSNRYCSQCASNTDFLVDGQCVSADAKKVCTPFDPPNGTCSTCAKGHLLFQGGCYDVSKSLGQEVCAETSEVQERTVCVRCAQPGFVPVSGVCLRYDEQEVTAAGCVTSRGSAVTSTDTVCESCGKDAFLYKGGCYSNKTSPGNVICDELDGTGGCKVCMKKYYRSGSTCTPCHQSCETCSSDAVDSCLSCKKDVYFEIFSGGRGYCKPCNDSVTTITIIGVANCEMCSPKPSGTIPICTKCTTGHVLKDNNCVQVCHEGAEGTGKCKTGYCNAISNTYCSECATPTECPVNGICTAHLDGHSAQNGACTSCAPGYFLYNGGCYRKGVMPGTLICKDEDDSTSTCSQCEDGYMPSGNGCKVCEVSNCRTCSGDAATCTSCDSGYLLKDSTRRTKVCEKVCEEGIGPGKCIYGGCTVRDNTFCNRCSEETEVPVDGVCSSAEEGTSICLSASSGACLRCAATHLLYYGGCYKIAQPVIEVCKQDSQIVEQGAAYCKACSVASEYPVDGACTAELDGNTCTSSKCTACGPGYFMHREICMRRESHPDICVRAGAGVCEECGKSYFKNPVASTAIDSCIACNDTAGISGYTGVDHCATCLPPKAAGPATCTECADRYVLNEQNRCEESCPEVDESSKATGKCLKGYCNVLNGKYCSKCSLESDYLVDGKCVSANSNVCTQHAQPNGTCASCATTHVLYMGGCYNPAAPPGNKVCAKHSLIGNTLYCFQCGVPTDFLVDGHCLVPSSTNSAVCTLHRVPTGTCYYCSSDYFLMLGSCVSAERAPGNTVCQDFGTDNGICDTCKEGYYASPDRSSVSDSCLLCTEDNGTLKGIPHCKSCKVSNGLLVCVVCEELYRPMNGGTECVQTCVEAEADPKEHRCKKGKCDVLGTFYCSQCAADAEAPVNGVCAPVAGGICIPYEQANGTCKYCTHGYIKYRGGCYETGSLEAEDICDAQDVVTSGAGSFCARCKHKDEVPIDGECKVSDDCTVKEDGICKSCKQGIKSFQIAKDGSSTTVACFTKCPDGMYESAEFCHICDKSCKTCRDSSIKCTGCADGFYLAAERCVACGVPHCLTCSAADTCTSCQDGYYVNGNSCTACTPGCKRCDGTGCKVCKDRFALDNNACTEACPIGLLFTSCAAGYCNVNGTLACSRCALSSSVIIDGKCKANDDACIRTVPSSGTCAACKDTHILYYGGCYDKSTAAGTAICDSQHQAMLGPYAVCKQCKRDGEVPIDGSCAALTDTKAIRSQCVAAASSPTSCTRCGPGFFLHAGGCYELGRSPGAVLCAVAADSAVAGVCTSCASGYYSTGLLDPTKESCILCNNTSETNGYTGVDGCMECYPSEAPRKVICTRCRDKHIPNEDGSQCVQSCNDSGSESGRCKADGCTAMDSLYCSRCALDDEWPINGACTARDTDYVCEKGKGVCTGCLRGYMLYMGGCYDPAAIPGSGICKELLTIGGRTYCKRCNIAGEFPIDGLCTKSVPAGISCSSGLCVVCPEDYFLHEGGCYSITTAPGSEICEVLGTGREVGTCRQCRPGYRHNKETLTCMPCTISNCASCEIDVDYCTECIQPYTLTGVGAGAYCAKVCKRVGQDACSWSSCTVMDGSLCSQCASSDYVPINGVCTLYPGDARSLAGPCVKDAAKGRCTACRGNYFLYQGGCYSASEYPGTGICDERDAAVLEGQVVCGRCLIDGEVPLDGTCAEPQEGLICSKGACSRCGEGMFLFEGACYTKGRAPGTSICGDTAKLTSGCAACEAGFSKTDKGCVRCSDPNCGACGGDPNTCTACRAGYYLQSTSCIVCHSACRTCDGAGADKCKECADGYFGTFVAPGPGTCLACSDTSGRDGWVGVSGCRLCDAPKVAGLALCRDCLPGYKTLSTGTGVTCHAVCPVAYYEAAGSCLPCATDNCAMCTSTACTSCVPEHIWNGEECVPEVCPAQCLCKEQSIACTGCRENAVEVRPTHSSASRCLLCSDARAGGGWTGVDGCQRCRLADRVGPVVCLACESGRKTLALDGVLLCPGDCPADGFWTSGSECIPCAAGCLRCTSATACSMCSQGYYSTQSAVSAPSDCRPCDDATSHNGFAGVAHCAVCTADRARAAVTCHACAEGYGLSGGSCSPCAVAGCARCDGGVCTSCKRGWYLAGDRCLACPSPCATCSSATSCLACADGYFQATPLGGPQDCVPCDQTAPQGLQVAGIYGCGLCQAQAGSSTILCLRCTNGDLPLENYCGGPSTGRRLGPGAIAGISLSMVVLVGGSIGLVLGLTVCKRGCAGNGSLQPLTI

SEQ ID NO: 307 - protein, 738 aa, Giardia intestinalis
MITAFYQYFGQSGAALSFQMSHLLFTRTGSMHYCLVPRIYLLLHNLDQAVMLLVVFYFVLNAFAAPCDPDGNHLTTCAHEKCEKINAFEVCTECKAGGVPIDGFCRPIGSPQVITAGCTKGDGTALEQMATTCGKCGSGYFLFMGGCYRTGSQPGSEVCTTAEGETCTVCNTANGLFKNPAAAPDAGRECLLCWDTVGANGHTGIENCRACTSSGQSGPATCSACKEGYYKDGNACTKCHSDCVTCSGTGQNACTLCANGKYLDGTSCIEVGQCNGNKYPNPNTGKCTACNAAVEQGGIPECTACTYDSKLQKPVCSACGGTKALLKKYVDGSTECVDKAGCAALSTVGTHFLSQDENSCILCSVTGGNAPDKGIAECSSCKKTDLGQAPTCTECLSGFYFDTTCKACGTNCATCSAETDETKCTTCKDGFFLAGTGEGKCISCKDGAEGSYKGVPGCSLCDAPPAAGPAVCKTCDPGYSLQGTTCVKACEDPTACGGTAGACDAMVIDNQGNTKHYCSYCGEENKFPIDGICVESGSANGNTCNNHVCESCTAGYFLYMGGCYKAANPPGNLMCTTAPAGICTEAASDKYFVVPGARSADQSVVACANPLGTLAGGNAYVGVDGCSTCTAPAGRDDGGMAVATCTACGEGKKPSKSGNGCVLCSVKDCKSCKADEKCEECSSGFSLENDKCVSAGASGGNKSGLSTGAIAGIAVAAIVVVGGLVGFLCWWFICRGKA

SEQ ID NO: 308 - protein, 43 aa, Giardia intestinalis
GGGSTNKSGLSTGAIAGIAVAVIVVVGGLVGFLCWWFICRGKA

SEQ ID NO: 309 - protein, 393 aa, Giardia intestinalis
MHVVRGLVCCLQGGRAGRLPEVQAREGPGAVGRRARDREVRRRVHGRRRVCGVRDRHRREQVLHALQGPEHVPAQRRVPCRRPGGPVLHQQGDGVCTACAEGAFLMSGGCYRTGVYPGSVICSVQSGGRCKETKKGYGMSDDGELLQCDPTCLECAAPGPGRCTKCPPGRLLRRASAAATGSCIEPGACADGYYADGDACLPCVVPGCRACGRTSFCTECAGELFVGLDGRACLRECSGDRVVGEASGGTRRCWCERGFAPALDRSGCVPAAECPPGMPWCASCDESGRCLSCAAPGHNIQVDQRTCAEGCGDRAAPDQGVCVCEIGTVLTRGACVSTKDAAKKKTAAIAAGTTAGILVVGALAGFLCWWLLRRGRRIGSSSSVTSLIHSKSM

SEQ ID NO: 310 - protein, 615 aa, Giardia intestinalis
MCPFDFRCTFVEELELGYCDSCPRDYVWSQFGCYSIGSIIGNSICLPRNVIDIREQTLCTQCANSSEVPRNGQCRSISRFEDICTKNSETGTCTSCKDRDKKQYFLFYGGCYLFGNTLDDHIGSQICQTVQNNVCTACNSSIKEVFTKDSRCWRCGDTANGGIAGCQKCEMKDDALQCLECRDLYLSLDKKSCLASCPDGQVGAFDPSSKSFICACDDGFYLNDGKCVKCTVENCAECNESKCSKCRYGYTLSDNRCAETKCKDPNCDACENRNVCTKCSNNYSLDQNGLCVKDCLSSAGYYKATVGDVSRCVACTLGGCAVCESADRCTTCRDGFYLESQERCKPCSSACATCSGPEAGDCTSCPAGKRLQYSDDSKGSCVSQCVKDGSCAECGLTIDGTSYCSQCVKSTEYPRNGVCASTGSRATGITCANAFGGQCITCGPSSFRLNGGCYTSKLLPGKTVCSGERDGWCENVAAGYGITYNGTLLTCPEHCKVCTDGSCSSCNSGFYPERGACRACSKGCATCPHGRACFDCLAGYYFSENTCKACHKAVPKCSLCAVPEGATQPVCLEYSRSLRLALSAGAISGITIGAVLVIGTVTAVLVWLLVFRKKS

SEQ ID NO: 311 - protein, 387 aa, Giardia intestinalis
MLVTLLLICTVIQANCTNNLTSCTRNPEAQCEVDGCIACVEGNTRECKTCGPDYTLNPDTKQCTRNPEVQCNTPNCKTCDNPKTDREVCTECNGDSYLTPTSQCVPDCTAIGGYYGDSADRKCKKCSSECAGCVGPASNQCSACPAGRALTYSDAGHPGNGGACGDACAADKNGCKACGAKIGGTDYCSHCSDNAQAPLNGNCATSSARVAFCAAMGAGVCTKCAAGYFLQDGGCYETNRQPGKQVCTLAGGTGECETCANGRQPNSGACPSCHPTCKTCRDTDSADACTMCAAGYYMLGSGPEACVSCEADSGSVKGVSGCLSCAPPSGNTGPVLCYLTKDDGTGGSTNRSGLSTGAIAGISVAVVIVVGGLVGFLCWWFLCRGKA

SEQ ID NO: 312 - protein, 287 aa, Giardia intestinalis
MITCTECATDNLSPLKDECMAACPAGTYANNDVCAPCHKSCASCQANDKETSCTACYPGPSLLYGVGGATGTCVKECTGEFGANCADGQCTADVGGAKYCAQCKDGYAPIDGVCTAVTTGRDASMCTAAGGKCTACKGSYALISGGCYGTQKLPGSAVCTAASNGDCSACANGQQSSGKACPACPAGCSKCTGSAPSQQCSECLSGYYKSETKCAKYDVSNGGIVGVFGCVSCAPPPSNTGSVLCYLMRGGNNTNGNINKNVLITGAIVDISVMAIVVGGLVSFLCR

SEQ ID NO: 313 - protein, 279 aa, Giardia intestinalis
MYASSSGNICKPCHTSCAECTAYARGEDSCTACYLGFVLRKGSSEATGTCIPECTGKYAENCEENMCSAVIWGSKYCSKCKTGFVPVDGICVSSTARAPTGCIPGDGVCTACTDSYFLQSGGCYQSTAFPGNKLCTTASQGKCTSCANGQQADNQGSCPACSSICATCVSGSPYQCQTCLPGFYRSEINCIRCSGNDNGITGIANCLTCAPPPSGQGSVICYVKKDGTSDGDDSTGGSTNKSGLSTGAIVGIAVAVVLVVVGLIGFLCWWFIHRRKARF

SEQ ID NO: 314 - protein, 855 aa, Giardia intestinalis
MRRARERADPALAPRGRGSLAQLGRPDRLCALEGTPGPLQSCGQACQGARSQRAPGGLGAGQGSSVLGPSRASHGACSRGLGGAPGWQLTPLPDARRVHWEGPCSTGHHQAGSAGRTPMLFAVLYLALGTLAAPCQPDGDHVATCQTDKCEMVDSAEICTGCKAGGVPIDGFCWPASSLPAALAGCAPGESPGVCTRCSSEGHFLFMGGCYKAGSSPGNEVCAAAEGGRCTACRTGGSVFQNRADSPALGSECILCSDASGSPGTANCETCTGPTDSAGKATCKTCRDGYFLESNECKQCGAGCSECTSSTACTLCMPGKYLKGDKSCSEVCDAKQYADPNTRECTACSESCKVCAYDDTLQQPVCSECEGAKPLLKKKIDGTAECVDADGCATVGQDGTHFRSDGDTKCIPCSDSSGSANDQGITSCEICSKEASQKPVCKACVSGFYLSGTCKACVGNCAKCGSTGSIQDCTECLPGYFLRDTQGTKECVACGDTSKNGVDGCAECTSEGAVKCTKCKPNYRQSREPAAGVTCTRVCEDEAACGGTAGACDAVVIDDAGKELRYCSFCGDSTKIPIDGKCVAAGSANGNTCSAGICTACANTYFLYMNGCYKIGQTPGQYMCTAAATGFCTAPDSKKKFFNIPDATKQEQSVLACGNPLGTVTGADGTAKAYVGVPSCTACTPPSAPSNGGMAAAKCTACEAPKKPNQDGSGCTLCAVAECKSCITDNVCEVCDGDKKPNKAGSACYACSPEGCSHCSADNRCEVCADGGKRPSLDGAQCITCNIDRCTRCSAEGVCGECEAGYAPKDGKCEPGSTGPNLSTGAIAGISVAAVVVVGGLVGFLCWWFICRGKA

SEQ ID NO: 315 - protein, 612 aa, Giardia intestinalis
MCPFDFRCKVANGNGAGYCDSCPRDYVWNQFGCYSVGSIIGNSICLPRNVIDIKGQSICIQCANSSEVPFNGNCETIVGSSDVCVKDAETGRCTACKDKGKTSYYLFYGGCYSASGTQTGIQICQTVQKNVCTTCDSSVKEVFTKNNGCWRCGDTANGGIAGCQRCETKGDALQCLECRDLYLSLDKKSCLAGCPGGQRGVQDPSSKSFVCACDDGLYLKDGGCVKCAAENCAKCNESKCSKCRYGYTLSDSRCAETKCKDPNCDACENRDVCTRCSNNYSLDQNGLCVKDCLSSAGYYKATVGDVSRCVACTLGGCAVCESADRCTTCRDGFYPNGSGGCKACNPACATCSGPEAGDCTSCPAKRRLQYSDGTKGSCVSQCVQDGSCAACGLTIDGTSYCSQCVKSTEYPRNGVCASTGSRATGTTCTNVVGGRCVVCGSSSFRLNGGCYTSKLLPGKTVCSGERDGWCENVAAGYGITYNGTLLTCPEHCKVCTDGSCSSCNSGFYPEKGVCNACPEGCATCPHGRACFDCLAGYYFSENTCKACHKAVPKCSLCAVPEGATQPVCLEYGRSLRPTLSAGAISGITIGAVLVIGTVTAVLVWLLVFRKKS

SEQ ID NO: 316 - protein, 650 aa, Giardia intestinalis
MTASKRAVMFYTFLWIGLVLQLARAKGECTPTPSGGPETCKACDAVINGKEYCSQCNDSGSELSSGAPTNGVCTADNAVCSAKKDGVCTTCKGESFMYKGGCYAKADEPGNTVCETVQNGVCTAAKAGYFVPPENDRDASHQSAIPCGSEEEIVVKNDHKYKGVPHCTQCNTPEKATDTNTAKAATCTACENGYFVDSGTCTACAANCLTCAGEADNKCKSCTAETHFLASDASEGPCISCGDATQGSGAWKGVAGCAKCTKPQSAGPATCTECAADKYLKTDSGATSCMSAEECKDGFFPTTDAQNNNKKVCAKCGDTGNGGIEDCAKCSLKAASAGAGPLVTCSECSSKKLSPLGDACLENCPAGTYPDNRGSAGICAPCHNSCANCSDNADTSCTACYPGYVLKWGSTGDTGTCIKECTGDFMAHCKSGGCTLNVGGSKYCDQCEDGYAPVDGVCISVTPTARDASGCKASGGKCTECGPNYALLSGGCYNTNKVPGNSVCETADGTGKCTKCANGQAYADGNCPSCSEGCGKCATNTNQCDTCYSGYYKTATHKCFKCATDSDSGIKGVENCISCAPPTSPPGSVICYVKTDGTSGGGGDSGSGGGSTNKSGLSTGAIAGIAVAVIVVVGGLVGFLCWWFICRGKA

SEQ ID NO: 317 - protein, 827 aa, Giardia intestinalis
MLGFLSVLLLASLYKASKTTYYNSFGVECREEHSNCVQDRCIPIGTRQACTQCIPGYVPIHGICTLYTNSISSVCIPDDASSPTRCIACKSETDVFLFYGGCYNINISTGDKMGEFVCAEASGGTCTKCREMTGGNYVFTNSDTGAAEKCILCADTVGFGSYKGVSGCFSCWPPINNKIGTPLCNKCYYTMTTVYFGPVDYHCQDQGSHNCNRGNCTSCYKTHLFYAGGCYSRHTMTGLAICAKSNQYELDNVTICAERSNASYAPKDGACTLVKKNTSSRNSFSECTKDESKGLCTACSSSSTFFLFYGGCYNKSSSLGSRLCLTVTTGDCTQWKGDFNFIFPKDTTGARYLCSDAAHNGIPRCATCSYEGNVVNCTRCSAGYLGMDGKSCNESCDGNTQGACTELIEKVSSAKVLSYQCVCKQEFYNNSGTCAPCAESCAVCKSSDAYGCLQCVPSKILNFSVTVSESTNCIDDCTASGECVECGVTIDGSKYCTRCRDPDMYPFNGVCTADAQRSSYCVSKESGTCTACSQNTFLMSGGCYKMDTYPGNTICIEESGGKCAKTKEGYKVSADGKLQPCAPGCVKCTAPGLGYCTECPLGVYLKKTSSAALTGTCASFDDCTNRYYIHGDACLPCVVPECRACGHTSFCTECAGELFVSLDGRACLRECSGDRVVGEVSGGTRRCWCERGFAPALDRSGCVPAAECPPGMPWCASCDESGRCLSCAAPDHNIQVDQRTCAEGCGDRAAPNQGVCVCEVDAVLTKGACVSAKEVARKRVAAIAGGTMAGVVVVGGLIGFLCWWFLYRGKRAGASSSTTALVRPKSI

SEQ ID NO: 318 - protein, 684 aa, Giardia intestinalis
MLLIALCFMLSALAEGCQEHGDHAVTCQVNKCEIVNSIEICTECKAGGVPIDGFCWPASSPSAALAGCVPGASSGVCTRCSSEGYFLFMGGCFKKGSTSSQTLGDSICETAQDGRCTKCKTDGNVFQNKADSPALGSECILCSDTTGANENKGVDKCTKCTAPGSKTGTATCTECAAGSFVSNQACTACNSPCATCEASADTCTSCETGKYLKENQCVAKGSCGADKYEDDASMTCVACSTIQDCTACTMDPTTKKPKCTNCGVKIPRIGLDGTSTCVEKSYAGCTGADKELFMKEDQSACLLCGDATTGPDAKDKGVANCKTCTKASATGAAPVCETCKEGFFKTSGALCEACGTNCATCSAKTDEAKCTKCKDGFFLAGTGEGKCISCENGNDSGYSGIAGCLSCKTPTTPGPVSCDRCKIGYMLKGTTCVKACEDNTACGGTAGACDAMVIDDQGNTKHYCSYCGESNKFPIDGICTNNKGTNNGCTDHTCGYCARGFFLYMGGCYDVSKAPGNYMCKIVGKEGICTEAANNKYFVVPGATSTEQSVLACANPLGTLAGGNAYVGVDGCSTCTAPAGRNDGGMAVATCTACGEGKKPSKNGNGCVLCSVKDCKSCKADEKCEECSSGFSLENDKCVSAGASGGNKSGLSTGAIAGIAVAAIVVVGGLVGFLCWWFICRGKA

SEQ ID NO: 319 - protein, 539 aa, Giardia intestinalis
MSSCHQSCITCDGQDAASCTSCNSTSFLAVQGNNKGYCISCNTETPVHGYAGIGGCSRCMLFSSIDVMPMCLECFEYDYMVSIDGRSCVTSCGVGASPNYYTRQCTCTTGYGLDQGNRAQGCVRCKIHSCALCTDNSDICNACEIPFGLSLDGKSCLETGGCPANCVCENNGTDAGTTCVSCKKKYFLQPARRICLHSCPIGYAANPVTNTCDLCPPNCYSCEQAVEDQCTSCVDRYVIYKTSSSVPTIGRCIPECTEAAVGPCTECHAILGSANYCSKCSSGFFPLDGRCVPTSDQQASTCIQADKGFCLKCTMGYFLHQGGCYSSLYTPGKLVCAAAERIDPAAYGTCRACTHGYHRTSDGVCIKCTMAGCLSCSSHPDMCTFCSNGYYSTQISVDSEDVYCNHCAPGCFFCEDPSPSACNLCAPGYFWTSSVHGCIRCDNSTVPGVLKGIKGCKQCLIPSSEISVVCLDNDPASPFAFPSPNTNKTTLILSITLPLVVLILATIIVTLVIIFVKRKTAKRPRPSTDPVTLATMASE

SEQ ID NO: 320 - protein, 822 aa, Giardia intestinalis
MTLASLVLILTYLLGVFSSDGESIYHNGFGYPCEDEKSNCLQNRCLRDLSTLFCTECASTHVPINGRCTPAGDARVTTAGCVKSSQGGWCTECGNNYFLFYGGCYELDEKWQTSICHRAENGVCKECGKGSEKYTQIVFTNPNATSPERCIYCGDVVGFGGYNGVYNCQHCSQPRLPEKTVPDCNECAEGTMCPFDYQCKPADEMAEFGYCEYCPKTHIGTEYACYAIGSITGNSVCLPSNIIEVQNRSLCTQCVNSSEVPRNGRCLSINKITDACTKDSKTGKCVSCKTSDEVKYFLFYGGCYAIEEEVMDQIGSHICQTVQDNVCTACNNSAEEVFTKNNRCWRCGDTANGGIAGCQRCETKGDALQCLECRDLYLSLDKKSCLAGCPRGQRGIQDSSSKSFICACDDGFYLKDGGCVKCAAENCAKCDEAKCSKCRYGYTLSDDQCAETKCKDPNCDTCENRDVCTRCSNDHSLDQNGLCVKDCLSSAGYYKATVGDVSRCVACTLGGCAVCESADRCTTCRDGFYPNGSGGCKACNPACATCSGPEAGDCTSCPAKKRLQYSDGTKGSCVPQCVKDGSCAECGLTIDGTSYCSRCTKGTEYPNNGVCASAGFRTVTSRCLNIANGQCALCDTDSFKLNGGCYTSKLLPGKTVCTKESNGWCDSITSGYEITYNGMLLTCPKNCAVCSGGICSVCNNGFYPERGACRACSKGCATCPHGKACFDCLAGYYFSENVCKACHEAIPKCSLCTVPEGATQPVCLEYGYVSRLAISTRAISGIIISVVLIIGIVAAVLVWLFIFRKKNKVSPLYNQSILLNTQ

SEQ ID NO: 321 - protein, 693 aa, Giardia intestinalis
MFDRLLFAGAVLQLAWAVCEANESGSAGSCKVCGVFIGESEYCSECNEPTTHAPVNGQCADVNTEGSSKTLCPQHSAGKCIQCGDNAFLYMGGCFSSGEGTPGKSVCHASSAGVCTEAAPGYFIIKGAKNTEQSVLSCGNTTGISVTADSGSTYKGVTSCAECSAPDAAAGARADKVAKCTKCRASKYLKNNECVDNAEACGKGYAAKQDAINGNKCIKCSNDQNGGITECEECAVTASTLESKGALVVCSKCTGKKVQPDKKGCIQDCPPYSSEKPEQSGICECNQGYIPSESGTECKEQPVLPEAQCSTSDCKVCSNPKKANELCTECNVDRSLTPTNQCVDKCDKLGNYYEGTNEQGKKVCRECIVANCRVCSAYGQCQTCKDGFYLNNNECKLCNDTCKTCEGGSESDKCTSCKPGKILRYMSATMGICEAECIVDPTQASGNCKACNLLIDGTKYCSQCSQIATEYPQNGVCKGNTKRAISPCKSGKIQDGKCTQCDVGYFLMEGGCYEDNKYPGKSVCSKTNVGGDTCDNVTPGYKLATGTLTHCIEGCSKCSDESSCTECLTGYALSGTKCIPCATGCSKCNANDATKCTACSIKYYLSKEKCVACDKNDGGSITGVPNCLSCTPPSGDTGSVLCYLMKDDGTGGSTNKSGGLPPGAIAGIAVAVIIVVGGLVGFLCWWFLCRGKA

SEQ ID NO: 322 - protein, 488 aa, Giardia intestinalis
METVLGGGEGTCVGDCTQTPGYYGDAGEAQNKKCKKCAAGQKPNTAGDKCFSCPDENCERCDSENKCARCNNGEPPADGACPVAGKGCHSSCDGCTEDAMTNQANKCTGCKEGLYLKPEPTDGQSGTCLTAADCTSDQTHFTKEKAGDSKKMCLPCNDATHGITDCKKCTLKTLSEGAEPIVVCSECADKWLTPPGNACLESCPAGTHVDNVNGVSVCTPCHDTCAECNGNADAASCTACYPGYSLLYGSGIAGTCVKECTGEFGANCADGQCTADIGGAKYCAQCKDGYAPIDGICTAVTPAGRASVCTAAGGKCTACTGDYALMSGGCYGVAKLPGKSICTLASNGKCTMCAANKQAPIQEKCPECSEGCAKCADSNACTECYSGYYKGAGNKCFKCTSGDNAVNNPITGVADCISCAPPTGGNGGPVTCYVKADGTSGGDDGTGGSTNKSGLSTGAIAGIAVAVVIVVGGLVGFLCWWFICRGKA

SEQ ID NO: 323 - protein, 530 aa, Giardia intestinalis
MLVGAILFLVVAFAVECNPPITGCLECATEATTCTKCDKEHATNKYLKDGSCVTGDECTGAHDHYIDSTDPSSLVCKACGKNEKPNTAGTQCFACTDSNCRRCNEANKCAVCTTGEPQSDGSCPAATPGCHSSCKECVNGASTNEDDKCLSCSGDNYLKVVDTATHSGVCVSVSACTSDGSHFTKEVADSNGSKKMCLPCNDATHGITDCKKCTLKTLTEGAEPIVVCSECTDKWLSPLGDTCLEKCPAGTYFERGTDNVGVCAPCHNTCAECDGNAEATSCRACYPGFVLSKGDADSTGTCIPECTGKYVENCEANQCTAVVGGSKYCSKCKTGFVPVDGICVSIASRAVIGCTPGNGVCTACTDSYFLQSGGCYRSTAFPGNKLCTTASQGKCTSCANGQQHTNVGTCPACPDGCSKCTAGDDPKECSDCFPGYYRSGTKCMKCDASDGGIIGVPNCISCAPPISGSGPVTCYIKADGTSGGDDGTGGSTNKSGLSTGAIAGIAVAAIVVVGGLVGFLCWWFICRGKA

SEQ ID NO: 324 - protein, 242 aa, Giardia intestinalis
MTLLLLKFGLIIAACVTPVMKSSQSGDCLVDKCTVLDKQYCAEHATPGEVPINGVCIPLTDPRAVASGCEGDAGAPLSTSARKCEFCRGENYFLHEGGCYSVLYNPGNRICRTVASGYCTLCVDGFFLGTASSTNQCKPCESTCATCKDGTVQSCLSCRSDRFLKNNECKECSTDSGIENCAQCSQESSVVTCTLCKEKYFIKEGKCIACADNCATCTSARPEDCSVCVSKYSYDLTAKSCT

SEQ ID NO: 325 - protein, 712 aa, Giardia intestinalis
MMAPKRTSMFYVFLWIGLVLQLARAECTPTSGGPETCKACGAIIGEVSYCSQCNGNGSESAPTDGVCTTDNAVCDPKADGTCTTCKEKSFMYKGGCYATNKEPGSTVCQDAVDGVCTQTKDGYFVPPDADASHQSVIPCGDEEVVTIGNGKKYKGIPNCLTCTAPENGDGADSTPKAPTCNTCKEGFFGPSEEPPCQRCTDENCATCGATGEGKCSKCKSADASGAKLYLKKGEGGTGTCVTEPACVQVEGYYIEGEECKKCSAPCIACTGQATHCTKCDLAGETPYLKDNNCVNEAACISGNTHYANATTKECKLCADGGLRDCTTCEIISANLVCKACTSGDKNKFGLEKKSCVKDCPENSKADSDNICACTEGFEPSSDWSACRPKSSCKTPDCQTCDNEGGENEVCTRCFSTHYLTPIKQCVRSCEELGAYYTDSNNACQLCDPSCAACNGEGSEKCTACLPGKRLQYTDENSPSGGTCVDGCKPQSGAGGCETCGTTIGGTNYCSKCSMPEEVPINGVCKADNSRAPICSKKDNQGGCATCASGYFRQDNGCYKTDRQPGIQICTLASQGDKCETCANSLPPSEAGLCPLCDSACKTCSSANDANTCSSCFVGYYQVGTRCVKCDTNDPNGNKPITGVKDCISCAPPDGGNGGSVLCYLTKDDSTGGSVNKSGLSTGAIAGIAVAVIIVVGGLVGFLCWWFLCRGKA

SEQ ID NO: 326 - protein, 833 aa, Giardia intestinalis
MLCPVKRQMLGFLLTLLFASFCESSRDTYHNGFGVACNDTQTNCAQDRCLSIGPWTPCTQCVSGYVPINGTCQKYPRDSSPPCTPDDPNSPTRCIRCTSTANVFLFYGGCYTIDDSSSSNIGKFLCSEALDGVCTKCFERDYRRDVFTNPDQTAAEKCILCSDTVGFSGYRGVSECLYCLSPITEKIGIALCIKCDYAAQDKNVYPIDYECQASGPHECINGYCISCYKTHLFYEFGCYSRHSSTGLAICAEANQYELDNVTICRECTNSSCAPRNGQCTLIKNEAFPGNSFSECKKDDTRGLCTGCSNSANYFLFYGGCYNARFAPGSKLCSAVVSGVCTQWNTQFGLLFNKSDKNGNLCGDTESGGISRCVMCNYENSALACTRCSVGYLEINGKSCSKSCGGDTQGKCTEVAEEGGLVKILSCQCVCNSGLYNNSGTCASCMDSCIVCTDGTLNGCQQCSPGKVLESSVITSGNAKCIDECTTHGSCLECGLTIDGSRYCTRCRDPDVYPLNGVCTKDAQRTSYCASKASGTCTACSQNTFIMSGGCYTTNTYPGNIICDKQADGKCTATREGYGISDDGKLQPCAPECLECTAPGPGRCTKCPPGKLLRRAPAAATGSCIEPGACADGYYADGDACLPCVVPGCRTCGHTSFCTECAGELFVGLDGRACLRECSGDRVVGEVSGGTRRCWCERGFAPALDRSGCVPAAECPPGMPWCASCDGSGACLSCAAPGHNIQVDQRTCAEGCGDRAAPNQGVCMCETGMVLTKGVCVSTKDAAKKKTAAIAGGTMAGVVVIGGLVGFLCWWLLYRGKRTSPSSIVTVSGRSKSI

SEQ ID NO: 327 - protein, 500 aa, Giardia intestinalis
MFAKLIFISLILQLTEAIRPAGRIESGNACPTLDGAGCKTCDSSSGEELCVTCKQDTDFLQLDKKSCRASCTGDGVIEDSGVNPKVCKCDADKGYQLQGGACVKGQNNACPTLDGAGCKTCDSSSGEELCVTCKQDTDFLQLDKKSCRASCTGDGVIEDSGVNPKVCKCDADKGYQLQGGACVKTQPSACKTENCQECTNKGAADEVCTKCNPTHYLTPTNQCVPDCTAIKGYYGDANEKKCKACNPECAECVGPVNSQCSACPASKALTYGDSTYPNLGGTCGDACTADKNGCKVCGAKIGGTDYCSQCSGTQVPINGVCVENASGRATLCTAKGDGTCASCAAGDLLKDGGCYKTDRLPGRSICTTASNNKCTKCANGLNADGNGVCGECHSTCATCSAAGAADKCKTCATGHYKENADNSADGTCKRCSEKIPGCKQCTSSSADSVICLESEAGTGGSVNKSGLSTGAIAGIAVAVVIVVGGLVGFLCWWFLCRGKA

SEQ ID NO: 328 - protein, 560 aa, Giardia intestinalis
MTAPKRALMFYTFLWIGLVLQLARAECTPTSGDSSTCKICGAIIGGASYCSQCNDSGSDPSSGAPTDGVCTADNNECSAKKDGSCTQCAQKSFMYKGRCYKDSQAPGNTMCETAQDGKCTTARVGYFVPPGADASHQSVIPCGDDAVITVKDDKKYKGVVHCAQCNTPDAASDTVTAKAATCTECVADKYLKTDSGATSCVSAEECKDGFFPTTDKSGKRVCVSCNDTSNGGINDCAKCSPRVSVAKEGPTITCTECATDNLSPLKDECMAACPAGTYANNNVCAPCHKSCASCQANDKETSCTACYPGHSLLYGVGGATGTCIKECTGEFGANCADGQCTADVGGAKYCAQCKDGYAPIDGVCTEFKSNTRNLPECSPKNGKCTKCTGNYALLSGGCYNTQTLPGKSVCKAVANSNDGKCKTCANGQTPDLATNFCPLCDSTCAECSTKNDADACTKCFPGYYKTGNKCIKCTESSNNGKKIDGVPNCLSCEAPANAGPVICYAKTDGNNTGDDDGAGGSVNKGGLSTGAITGIAVAVVVVVGGLVGFLCWWFLCRGKA

SEQ ID NO: 329 - protein, 424 aa, Giardia intestinalis
MFYSTVLILCELVLVTSKECSNSENCAAGDNCLDIKVSNTPKEVCTKCAATHVPINGACQAKDGQSAVCTPPGVADGTCQSCKGENYLYEGGCYTACPQGAPNPETNTCDGVPAPDCNIPNCEACSEDKKTCTTCQPGHLLTPEKNACLGACPAGSYAAGQACTPCDPSCAECSGAGASRCTACPAGKMLRYADEGRPADGTCAEGCVEGPECEACGLTIGGTKYCSKCAADRWAPRNGVCADTAAARSPFCTSASGGACTQCAGGYFLQEGGCYQTTRLPGKGVCAALTGDGKCQRCANGLAAVSGTCPLCDSTCATCTEPGQPGKCSACPPGRYLDAGNACRPCTEASGSIQGVAGCVSCAPPYPPSGAVTCYVKRGDSAGGSVNRGGLSTGAIAGIAVAVVVVVGGLVGFLCWWFLCRGKA

SEQ ID NO: 330 - protein, 638 aa, Giardia intestinalis
MLLIAFYLLLSVLAAACSAEGTVKDNCEADHCEMVGTTEVCTQCKTAGNVPINGVCTLHSEGAVTSAGCKKKDGNTNVGVDDKTCGQCDGAYFLYKGGCYSTSDATGQKLCTAAAGGVCTKAAAGYFIPPDAQKTDQSVIVCSDVTEVTLTNNKKYKGVQHCTVCTAPGAAADSTAKPAVCTECSEGFFVASSGSECKACGDENCAKCEREGKKQCNECKATDTKVYLKIEADSKTGECIEKASCNGDYFPNDNVDGKKQCIACGSGTHGGVANCKTCTLKGKPEGSILITCSVCTAGTSKPSTDGTKCVQCSVDGCDNCNEDNVCAKCTNDKKLTPTKECIDKCEKLEGYFNGNDGTCKMCNSVCKTCSGEDLHQCTSCPARKVLKYTTEGTPENGSTCVDECKTDTNGCAECGATIGEARYCSKCSDAKQAPLNGNCTVSARAAASCKKVEGGVCKECEAKYFLFEGGCYETARQPGMQICDSIANGKCQTCANTLKADTSTGACPSCPTGCATCTAAAAGQTYTCQTCFTGYYLDSTKNLCIKCTESSGDIQGVTNCASCAVPTSNSGPVTCYAKKDGTGGGDNSDGDNSGSGGGSTNKSGLSTGAIAGIAVAAIVVVGGLVGFLCWWFICRGKA

SEQ ID NO: 331 - protein, 654 aa, Giardia intestinalis
MRAYRRLLRLVQKSRLPLLRRLLRLGQGPGEPRLQQGGGRDVQGVPEGRAVPVYKPRRRRGGAVHPVPRQRRLRAVQGRRRLQVLPAPPRRGDVCRVQLVPEREARPDRRGVHGAGQALVRRRGLLELLHDPRPAQRGCYEKAKAVAQKICAAEDQFQALNITACRRCALEGEVPADGRCIRAALEPKCSPDPAAAGSCADCKRGGVSYDTFLFSGGCYNTSGYVGSQLCTKVNDRAECDAWNTGDYGVFKLPDYHMAYLCSNTSAGGVQGCSRCRYDSTKKKAICYDCEYDMLAFDGMSCITGTDCKGDHRQRRCSGSSERGCRCECADKYYRSGEQCSACASSCLRCNSQEETSCTLCPSGQALAYNGNGTAGTCKAGCTPDSTCEACGLEVDQTKYCSKCKDPAQYPLNGACTPASSARTSVCQRQSDGACQQCSSDYFLMGGGCYQVSKYPGRFVCKQADGGKCVDTTDEYSINSKGELVDCNSNCETCVEGQRTQCLSCAPGRYLKKEGAAPHGACVSRADCSDGYYADHDAMECLPCGIDGCSLCHLIGASVRCSRCRGASLVGLDRRSCTTAAPENAVEFWGMYVCDEGSVLSGDACVRKGSQDAGGALSSRASIGIGVGASLVVLALVGVLAWWLVFQRRRTRGAQ

SEQ ID NO: 332 - protein, 674 aa, Giardia intestinalis
MGERGPPARVAVARMGDCSGSRLQPHLGETESKSLAQINKAMLGLLFLRVVVSSATGVFGEKCTTAVQKDTCATNKCITVSGSELCRECIGRKVPIDGICKDITDFSVSLYGCEHSSGTGFCTSCKDTAFLFYGGCYTINKAPGNLVCSKAESGKCTECRKGARSLFTNPDSSAAERCILCYDNVGFGSYKGVDGCRYCLPPFAEETSAECNWCQNEKYGPVDGVCTDPGKHSCADGACSNCYMTHIQHNGGCYEKTGAVAQKICAAKDQFQALNITACRKCALEGEVPADGRCIRAALEPKCSPDPAAAGSCADCKRGGVSYDTFLFSGGCYNTSGYVGSQLCTKVNDRAECDAWNTGDYGVFKLPDYHMAYLCSNTSAGGVQGCSRCRYDSTKKKAICYDCEYDMLAFDGMSCITGTDCKGDHRQRRCPGSSGRGCRCECADKYYRSGEQCSACEGSCLRCSGPEAASCTLCPPGQALAYTSDGEGTCGAGCTPDGTCEACGLEVDQTKYCSRCKDPVQYPLNGACTLGGGARASACLRQSGGACQQCSSGYFLMGGGCYQVGRYPGRFVCRRADGGRCVDTTDEYSINSRGELVDCSPDCETCVEGQRTQCLSCAPGRYLKKEGAAPHGACVSRADCSDGYYADHDAMECLPCGIDGCSLCHLIGASVRCS

SEQ ID NO: 333 - protein, 833 aa, Giardia intestinalis
MMALIFLLLYGIFSECAQDSDCGGASGVCNVTIGGRKYCSKCEGARVPVNGDCRLLSLSRSICVVPTDNNPTPGSCSGCIRDFLFYRGGCYRTAALINAICKEKHVVEEGMYCGACGIEGDVPIDGVCVPAGSAAGNTCDKGVCTACTAGYFFHYGSCYRFGGSPGSIVCPSQSDTAGSVCGSCGPRFVKNPNASSSATSCLACYGLDGTLFCERCRMSVLAGADAKPTLCTQCQLGYVPVDGRCLSNYSALAALAGCSDPRGNGLCGACSPGYMLFYGSCYSVDGPLAQAICAAEDQIYVNGRVLCKKCAQPDHYPLNGVCIAQGSDAGGHTCSGGSCTACSSKQTADNTPEFFLFYGGCYDITHPIGKSICSAIAGSVCTACASSDSSNVITVAADDQSSTCLACWDSAIGGAANCGGCSPGGDGPAKVVCTRCADSTAPGEDGACPRALPPATPEGCAVQGCRACSEDSATRCDACFDPLIMKEDGAKCFGSCLALGPGYYNASGTCARCVENCLLCADGASCSRCADGYYLEVSGDGSSTGACRPCAAGCSTCNNGTDVGCTTCLLGYYLASTSRVDRAAKCVACSADENGYTGVPNCIACRSTVGTGGAKNVICQKCADGYLKETEQGKTVCEKPPPTCTVELCALCVADDPSRCEHCTAGAYLCPRTAACTKDCASCGGSMYPDGDLGECQPCDIPSCRVCATGLKCESCAEDAVPISPDVYHTACMGCSDTGGMDGWVGLAGCTTCELTDRGGGSVNCLDPGYYRRGGLGGGAIAAIVIAVLLALAVVGFLVWWFVFRKGRSSRRGGAKYTSLMRGESYDYRQSLI

SEQ ID NO: 334 - protein, 714 aa, Giardia intestinalis
MKDPGRHWEGPCSTGHHPAGSAGRAPMLFAVLYLALGTLAAACQPDGDHVATCQVNKCEMVDSTEICTQCKAGGVPIDGFCWPFSSPQVITAGCTKEDGADLDSTANTCGRCSGADHFLFMGGCYNQKVGIGGTICTAASGGECNTCAKVGWLFENPAESPAPGTKCILCSDTVGDGKTMGIANCNACTAPRATGAATCVTCRPGYVKDQAKNECKKCGSGCSECSESNPSQCSACEDGNYLNTNTCVAVDGCGGDRYADPTTGQCKPCNGITDCETCEYDEAKGKVKCKTCGSSKIPRTAMDGTSTCVTKDYAGCAGANKDLFMKEDKTCVLCSTVSVGADPNDQGIAGCKKCTKESATPPTCSECFDGYYDSGNGAPATCVACGENCATCVKDTKDLCTTCKSGFFMKGNGPGECLPCDGEGGAEGCGICTGGTSFTCNSCKPNYRQTGARSGSVTCTKVCEDETACGGTAGACDATVVDENGTTKHYCSFCGESGKFPIDGKCTNVNAGNDGCANGVCKSCTTGYFLYMGGCYSTANPPGNLMCKTANGGICTEAASDKYFAVPDAAKTDQSVLACGNPLGTAVGEKTYVGVEGCSQCTAPAQLEASGMASATCTACGEGRKPNKSGTGCAACSSRTAGTAGWTVYVKSAAVASAWRVASVSYPPALVEVTGAASARGPSRHAVAVVSSSSGASSASSAGGSYAAARRRLR

SEQ ID NO: 335 - protein, 771 aa, Giardia intestinalis
MAGWEARPPDGPQSQRPKDASSQALAEWVTHGEQRRGRRADHRHSDRPGCSGGRGPSGILHQELPHPVDTAMLLIALLFVSSTLAADCQPDGDHAATCQTGKCEAVGSSEICTQCRAGGAPIDGFCRPVGSPQAIAAGCTKGDGTALEQTAATCGKCGSEYFLFMGGCYRTGSQPGSEICTAARDGKCTTCKTGGGVFQNPAIDAVLGSECILCSDTTDRGGIMGVENCAACTAPDNSAKGAAKCIRCNAKFVKRADGTACLACGSGCFECSEGNPNQCSACENGKYLKADTHTCVDGAGEACGAGNYADRTTGKCENCKTGSSSGGAVQGVEGCEACSVNTETGKLRCTVCNGSGSKTLVKVAIDGTTTCVAEAECTTGSMNFLSDSKKECILCDNTTSVTPNDKGRLGCKTCTKSNAPPVCSECLEGFFTKDSGATCTACAKNCLMCNDANADQCTKCSPGFFLKSNKTPGECIPCDSTENGGSEGCGVCSNSGTFECTDCKPNYHKQAGGGSAVTCEKFCEDETACEGTAGACEAIVVQDNGDFLHYCSLCGDPNTFPIDGKCVDNAQGNTCANGVCTQCAAGYFLYMGGCYDVTKTPGNLMCKAAGQEGICTEAASDKYFVVPGVTSNTEQSVLACANPLGTLAVGNAYVGVEDCSQCAAPDARSDGGMAVATCTACGEGRKPNKSGTGCAACSIENCRHCRVDDVCEECSSGFSLEGGKCISTGTSGGNRSGLSTGAIAGIAVAVVVVVGGLVGFLCWWFICRGKA

SEQ ID NO: 336 - protein, 666 aa, Giardia intestinalis
MLFVAFCFVLSTLAATCSVDSQVGNCKKGMCEMVGNTEICAECEAGNVPINGVCTAHNDGKVSSAGCKKKANDSVDASSVKCEQCDVANYFLYKGGCYSKDVAPGNEMCKTVTTNGICAEAADKKNFFAVPGATKTDQSVVWCGDVEGVTLGDGKKYTGVADCATCEKPGQLPASGTKAATCSACKGSKLVKTVGDVTSCVEESDCNSGFFVNTNSGRKCTACADENCDVCGAPEAKKCSKCKTNGEKVYLKKENADPTGVCVNAGDCTAGNTHFADDTIDPANGKTCKLCKDGGLTNCAKCEKQESGLVCKDCTAKFSLGKKSCVDECPPNSKAGLDNICACAEGFEPSSDWSACQPKSSCRTPGCKTCAGEGTDKEVCTACLEGKYLTPTSQCVPDCTVIEGYYNDRTANRCEKCNSNCKTCLATDRDKCTSCPAGRALTYEGDPAHGGTCGDACKVSADGAGCEACGAQIGGTAYCSKCKNTQQAPLNGNCAANARVAFCATVTGGACTKCNEGYFLKDGGCYQTDRQPGKQVCSSAQGGACNQCANGLQAQGGACGECHSTCATCSTADAADKCKKCATGYYKTSDSEGSCKKCSEGLAGCRQCTASANAFVCFEMGDNTSENVNKSGLSTGAIAGIAVAVVVVVGGLVGFLCWWFLCRGKA

SEQ ID NO: 337 - protein, 739 aa, Giardia intestinalis
MFSGFVFVGLIVQLAWTEQVAERAREAQCADNTSNCESCNVLIGDKLYCSKCKADPADHAPVDGVCTDVSSSKGICKQNADGKCTECDGESFMFEGGCYQINQVPGQTMCKTAETGKCTAAPDSRNYFVVPGEERKSTDQSVVLCGDKTGLRLTSGKTYKGVDGCTECDGSALTDQADGTAKCTACGDGKIVKTAKDQATSCVTEQACTDEEGFFVDAGERKCTACADEECAVCAAKEQRKCTQCKTSGTKKYLMKDGESATGTCVDTAGCPATHYIDEEAKSCSTCVSGGTVDCTTCEKGAGGAVLCKTCATGAKTKFGPGKKSCVESCPSNSSEEKTPGTCECVEGYVPDEAGTGCKKSSDPPAAQCSTPGCKTCDKPKAGEEVCTECEGAKALTPTGQCIDKCGDLGGYYEGTNDKKKKACKKCEVANCLLCNREGKCATCKAGFYGEACAACNSACKNCSGPTAADCTECSSGKALKYDTSGAKGTCGAGCTPNASGCEKCELTVEGTTYCSKCKEAGQFPQNGVCSAAAGRAVTCTSQGSGVCNTCANGLLHMNGGCYETAKFPGKSVCKEVAPGGETCQTEAPGYHLDNNALVVCSAGCKTCSSNTVCTACMDGYAKTDKSCTKCAAGCATCQGAAETCDTCSTGYYKSKNACVLCTANNADNTITGVANCASCAPPSGDKGPVLCYLMKDGGSTNKGGLSTGAIAGIVVAVVIVVGGLVGFLCWWFMCRGKA

SEQ ID NO: 338 - protein, 239 aa, Giardia intestinalis
MLLVSLYFILGVFTTTCTGRAKSNCANNKCEMLVTTEICTQCNAGFVPIGGVCTAHGDPTVVAGTGAGCQKAGDTAVDGGSTVCEKCTEANYFLFMGGCYKTGEAPGTLICTAAASGKCSACVENGYVFKNKNSSPTLGTECILCSDDTGSNGNKGVANCATCTAPSAESGTATCKTCMPEFALDGSANACTSNSGTGGNTNRGGLSTGAIAGIAVAVVIVVGGLVGFLCWWFLCRGKA

SEQ ID NO: 339 - protein, 690 aa, Giardia intestinalis
MLLIALCFMLSALAAACRQDGDHVIACAHEKCETVGGAEICTGCKAGGVPIDGFCWPASSPPAALAGCVPGESSGVCTRCSSEGYFLFMGGCYKAGSTSSQTLGDSICETIQDGRCTKCKADGNVFQNKADSPTLGSECILCSDTTGANKNTGVANCLKCTAPGNKEGAATCSECAAGTYKKSDAECAACHSDCETCSGANQNQCTSCRDGKYLKDGNSCVDKVGCTANTYYIDELNVRCIACSTIESCTQCKLGTTGKPECTACDGQKIPRTILDGTSICVTKGYDQCQGTDKEMFMKEDQSACLLCGDATTGSDAKDKGVANCKTCTKASAGAAPVCETCKEGYIKKGDGAGATCASCHENCATCSAETNEAKCTKCKDGFFLAGAGEGKCISCENGNDSGYSGIAGCLSCKAPTTPGPASCERCKIGYMLQGTTCVKACEDETACGGTAGACDAMVIDDQGNTKHYCSYCGESNKFPIDGICTMDKGTNNGCINHFCGSCGAGFFLYMGGCYSVSKAPGNYMCKIVGKEGICTEAANNKYFIVPGAQSTGQSVLACANPLGTLAGGNAYVGVDGCSTCTAPAGRNDGGMAVATCTACGEDKKPNKSGNGCVLCSVKDCKSCKADEKCEECSSGFSLENDKCVSTGASGGNKSGLSTGAIAGIAVAVVVVVGGLVGFLCWWFICRGKA

SEQ ID NO: 340 - protein, 722 aa, Giardia intestinalis
MYCGACGIEGDVLINGVCVAAGAESSGNTCDKGVCTACTAGYFFHYGSCYKFGESPGSIVCPNQSDTTGSVCGSCGPKFVKNPNAGSSATSCLACYGLDGTLFCDECRISVLTGEGAKPTLCTRCKSGHVPIDGRCVSAYSATAALAGCSDVSTRGLCETCSSGYMLFYGSCYSVDGPIAQAICATENQIYLGGRVFCRQCAQTDHYPIDGLCIADKGSHTCADGVCTACDTSKTTPLDNSKVFLFYGGCYNASSAIGSLICLDASNGACSTCNTTGTSNVIANPSSADGQPKCLACWDEAATGVANCGGCAATTEGDSKIVCSKCTDSTEPKDNACPQALPPATPEGCAVQGCQACSKDSATACDACLPPLVMKEDRTKCFGSCLALGPGYYNNSGTCSPCMEHCLLCADGATCSQCDEGYYLALSSTNPPQGTCRACAAGCSACNDGTDTGCTACLPGYYIASESKANRAAKCVLCNTTEGGYTGIPNCVACFSTVGNNGAKNVVCSQCEEGYVKKHDGSQTICEPPTPECNVAMCSVCADNSPDRCEHCTTGAYLCPRTAACTKDCASCGGSMYPDGDLGECQPCDIPSCRVCATGLKCKSCAENAVPISPDVYHTACMGCSDTGGMDGWVGLAGCTTCELTDRGGGSVNCLDPGYYRRGGLGGGAIAAIVIAVLLALAVAGFLVWWFVFRKGRSSRRGGAKYTSLVRGESYDYRQSLI

SEQ ID NO: 341 - protein, 636 aa, Giardia intestinalis
MLLIAFYFVLNALAANCKGDGSQHTVCAEGKCDMIGNIEVCTQCKTSGNVPIDGVCKAVAEAANKCTKDNDNPVDNQDTTCGKCTNAYFMYKGGCYGTTSAPGNKMCKTAADGVCTAAVDTKEYTTIPTADRDATKQSVIPCGSIEEVTVKENKKYKGVAHCTKCREPAKNNSDTAVAAVCETCEDGFFDAACTACHDSCKTCEAAGEDKCKSCKDGYFLGATSNAAGKCIQCNSKTESNWPGVDNCAKCTSSNTQNTPATCTECMAEFYLKPAVDVTPPSCVAETGCGEGFFPATVDKVKKCVACNAKDNGGIEDCKKCSFKTSSANAAPILACTECNTKWLSPVGDACLEDCPAGTHPHDGQVCPSCHNTCAECSGNADATSCTACYPGFVLKRGENGNMGTCIPECTGKYVENCEANQCTAVVGGSKYCSKCKTGFVPVDGICVSIASRAVIGCTPGNGVCTACTDSYFLQSGGCYRSTAFPGNKLCTLANNGKCTRCANGQTADNSSGSCPACDSTCKTCTAKEDPNACSACFPGYYKSGTKCVACDKSDGTINGVENCSSCKEPTGPSGTVTCYVKNDGTSGGGDSGSGGGSTNKSGLSTGAIAGIAVAAIVVVGGLVGFLCWWFICRGKA

SEQ ID NO: 342 - protein, 523 aa, Giardia intestinalis
MLLEITLLCVVALSRQCASLVLECIECDESTGKKCIRCDPKSDTPFLMETPPGNEKNPCVQDCTQTPGYYNDASDAQNKKCKKCAGNQKPNTAGDKCFSCSDENCERCDSDNNCARCSNGESPGDKKCPVATNGCHSSCDKCTSNAMTNQTNQCTSCKEGLYLKPNSVDGQSGVCLTAGECTSYGTHFTKEKAGDSKRMCLSCSDVTHGIVGCKKCFSKTLSGKTELTVVCSECTGLWLSPLGDACLDGCPDGTYSGRNNDNIGICAPCHNSCASCEASDAETSCMTCYPGAVLSHIDDDTGKCIPECTGGFTAHCKAGGCSLNVGGSKYCDQCEDGYAPIDGVCTEVSSTARDASGCKASSGKCTTCSGSYALLSGGCYDTNRVPGSSVCEKADGNGNCTTCANGQKYTDGNCPSCSEGCEQCTTNTNQCETCYPGYYRTGTGKCFKCAANGDNGIKGVPNCVSCAPPASGSGPVTCYLKTDGTNRRSLSTGVIAGVSILAVIVVGGLVGFLCWWLLHKKKA

SEQ ID NO: 343 - protein, 624 aa, Giardia intestinalis
MLFIVFYFVLNTIAATCTGAQASCKPDKCEALGDSEICTECKEQGNVPINGVCKTHDSSETNTAGCKNGSNSAPTTEVKCTKCTGDKYFLFMGGCYNQASLPGSTICTATADGECTSCAVVNWLFENPTDPLTTPGTKCILCSDTIGDGTTKGIAHCATCTAPDAKGIATCNICGNGYYKDDGGACQLCTSPCATCSGAGTDKCTSCKESGGNEYLRIKDSQSRTGECVAQSACTGESTHFLVTDIKTCYPCGSVNDGGIEDCLKCTANTVSDSIKGITVKCSACTSNTNKPNVAGTKCVACTIEECARCNDDSTCAECTPSNYLTPTNECTDDCEKLSNYYSDDNKHTCQSCDPGCTLCLTTDKTKCTACPAGKMLKYDDDTHPDRGGSCVDECKEGTNGCEVCGAIIKNTKYCSKCKTATEVPVNGVCTADNTRAPACLNKDNQGSCTTCANGYFRQDGGCYKTDRQPGMQVCSEATGGNGLCVTCTNTLPANNGLCPTCPDGCAKCTGAPSSRQCSTCYSGYYLSGTVCVRCTESSNNGNAITGVADCLSCKAPNGAGTVTCYVKKDGSSDGGNDNTDGNVNQSGGGLSTGAIAGISVAAIVVVGGLVGFLCWWFICRGKA

SEQ ID NO: 344 - protein, 546 aa, Giardia intestinalis
MCAMWLAASGRCFHCLPNRYSSFKLAASILRRAMLYLTALVLIGLASVDSLAPKQCNGAGATKCASVGDNCLDIKNNGVTKEVCTKCEDTHVPIEGACQEKGAQADKCTPQDPPDGTCKACLGSHYLYAGGCYAACPDGTYADAGVCKPCGASCVKCEKKDAGTRCTKCEDTHVPIEGACQEKGAQADKCTPQDPPDGTCKACKGGSYLYKGGCYASCPQGTPNPETNTCDGVPAPDCNIPNCEACSEDKRTCTRCQTRYFLTPEKNACLGACPAGSYATGQACTPCDPSCAECSGAGAPKCTACPAGKMLRYADEGKPTDGTCVEGCVEGPECETCGLTIGGTKYCSKCKGSSVPLNGVCTSNAARAQFCTTAADGACTVCAAGYFIQGGGCYETTRQPGEQICALTDNKGKCQTCANGLGPDGAGTCPSCNPTCKTCSAANTASTCTTCATGYYKTTQEGVCTSCESDSNGVTGVRNCLNCAPPSTGSGSVLCYLMKGGDSTGGSTNRSGLSTGAIAGIAVAAIVVVGGLVGFLCWWFLCRGKA

SEQ ID NO: 345 - protein, 405 aa, Giardia intestinalis
MLLTSFCFVLSALAANACTDDQLNTCDTNQCETLGTTQICIQCKTAGHVPINGVCKQQGDEVSNAGCKNNAGAEISTEKTCGQCDGAYFLYKGGCYGTNNEIGQKLCTEATGGICTAAATGYFVPPNAQKTDQSVISCFEETQLTVNTKNFKGVPKCLICDPPTTTTANPNLPTCTVCEDGTFVDSDGAVCTQCSDVDCAKCNDGANKCTKCKTKYLKITDANTGVSECVDADTCKAGNSYYQDDTGTIENGKLCRKCDESVTGCNKCTSTPISDVRTTTVIKCTECTSPDANKPNVAGTGCFTCSIENCSNCSENGICEKCGSSKKVSPGKKSCIEKCPENSTDTESVCVCNSGYGPDSAGTGCVTVSTNLSTGAIAGISVAAIVVVGGLVGFLCWWFICRGKA

SEQ ID NO: 346 - protein, 727 aa, Giardia intestinalis
MFSGFVFVGLIVQLAWGACTQEEGDDKCKTCGVTIGQEKYCSECNGANYAPVNGVCTDVSGQKEVCKTNAAGKCTGCAGESFMYKDGCYQTSQAPGQTMCKTAAGGKCTEAVESKAYFIPPGADDAHDSVVGCGDVDGVTLTGDKKYTGVAGCTTCDGTQLQVGASGATKCTACGDGKIVKTAKDQATSCVTEQACTDEEGFFVDAGERKCTACADEECAVCAAKEQKKCTRCKTSGTKKYLMKDGGSATGTCVDTAGCPATHYIDEEAKSCSTCVSGGTVDCTTCEKGAGGAVLCKTCATGAKTKFGPGKKSCVESCPSNSSEEKTPGTCECVEGYVPDEAGTGCKKSSDPPAAQCSTPGCKTCDKPKAGEEVCTECEGAKALTPTGQCIEKCGDLGGYYEGTNDKKKKACKKCEVANCLLCNQEGKCAACKAGFYGEACAACNSACKNCSGPTAADCTECSSGKALKYDTTGAKGTCEAGCKPNASGCEKCELTVEGTTYCSKCKEAGQFPQNGVCSAAAGRAVTCTSQGSGVCNTCANGLLHMNGGCYETAKFPGKSVCKEVAPGGDTCQTEAPGYHLDNNALVVCSAGCKTCSSNTVCTACMDGYAKTGNSCTKCAAGCATCQGAAATCDTCSTGYYKSKNACLLCTANNADNTITGVANCASCAPPSGDKGPVLCYLMKDGGSTNKGGLSTGAIAGIVVAVVIVVGGLVGFLCWWFMCRGKA

SEQ ID NO: 347 - protein, 614 aa, Giardia intestinalis
MLSAPWIASSMFDRIFFGIIILQATQAAETCPKVSDESSQPGTCKKDNCNVWIGGSSFCSQCSTAAEYLINGKCIDTNTESACENTPDNGVCTSCKAGFFLHRGGCYKIGTEPGNLVCEDMQASQTQGTCDVCRSGYFRNPFNNLDKTKESCIACNQTTAIDGSTGVANCQVCNPLETPGTVVCALCEDGKFGETCATDCNADCKSCSAGTANDCTSCNGGKYLKVANEQATSGQCVEKVTCTSTYFPITADEKCYPCNTVSRGGVDGCTACSKPGDSVICTACTGIKKPNSAGTHCFECPTEGCEKCSADNACEKCSGDKKLTPTKECVDKCEELGGYFDGSDNNCEKCSPTCKTCTKAANQCSSCPAKKVLEYNSESNLEYGGTCIDECTVGANGCAECGATIGEAKYCSKCSDASKAPLNGNCTVNARASASCTQIENGVCKKCTADYFLFEGGCYQTTRQPGMQICSAIDGATGLCQTCANGLAADKGDCSAQKCHITCKICSIANDPSQCKRCAAGYYKQSDEATAGKCDPCSQGNDGCTLCKYSTTFICLSTDSLDDDGTDTTPVDPPSSNKSGLSTGAIAGISVAAIVVVGGLVGFLCWWFICRGKA

SEQ ID NO: 348 - protein, 1335 aa, Giardia intestinalis
MLVLPVGLLVLRAVHTKVFSPVGITASSIKCYHSLKLGEDTVCTDCGTLNTVPINGVCVPDDPNICIILQGYNTKCGSCTSDYMLFEDGCYDLNGKYASLICTPENRYVLEGTTYCSRCAYLDYVPVNGICDSASLFDTCANNVCTKCGFSSFLFNGGCVSKSSSLGKLVCAGTVSDGKCTQCADGFSADATGMCVPCESPNCSSCPDDKNTCSSCKEGFFLDSTSVCVLCKHHCAVCSSEYDCTKCRANAQELTIGSEKVCIGCGDTSSQHGGYLGIEFCAQCTLPSIPGPVQCHKCFQNYYSLTDSTTGFVSCYAACPIGTYGDTYSMSCKSCSANCRICEGSYGCTECVPGYYLDFMSCTPCKIPGCSKCTSNYAGDICEMCLPETPYMNLAGTECVASCPVGSKPDTGTPTKCICDFGYGLAESKNACVKCSDKYCKLCTENSNVCTECFYGNKADETAECPPPVCADNCISCTQAGHNFCDVCQEGFRLTADLKCARCSDENCLTCADDVAVCTRCQYGFRISSSGTCIQCGLGCKVCNESMCIECSNAAHSIGIDGISCDAECPSHSTPVSDDNTSRCVCNDGYIPELEARLCVEEPKICPLGCICETAPICNGCADGFFEKDPNRIDSGRCHSCALTTDSQGGQTTTGCKTCRLVEDTVLCNECLPNYKLYDSNGVIHCMKTCPSGTHDTGSHCVKCLTNNCMQCNTDKAACEMCVREYYLWENECISCNSLECAECGLSNICTKCMSTKKCNACAIPHCRTCNALGKCTVCEKGFYGPLCQPCGDNCLTCSLENFGVCLECQPGSIISMGNCYNMCTEGEGSGKCAVGSCNMQTGACMRCSVPSEFPINGLCTSDPHGNDCLAGRCVGCTAGYFFYGDGCYSLTAAPGNGICMASLRGYCTACHDGYSLQGNECVPCKVSGCAKCASDPTICELCTIEAYVVDPAGSSCVPECAVPNFGVNSSSKHCVLCTDQNCLECINIADTCSRCKIGYHLVEGTCVACHSTCLTCSGPGESDCLTCIRGKVHSAGTGPSTCISECIENSRNCLQCNAIISGTAYCSQCAVGHYPINGDCRATARDLICLNGEDGICTHCAPGYFLYSGGCYQSERLPGSYVCAQSATGEGVGICNKCQLGYMPLSGSCTPCESINCQVCEYSVDICTVCSDGYYGDNCVQCPKACASCKSNLQCTRCAEGYFAAIDYEIFDPSHCIACSDEEGKDGYIGKQGCLSCIGPAIPGPVLCLSEAGSYAPVAPLASSTRLPLIIGLSVTVVVLLLVALGILLWKLLSAKKLNRTRCVHLPGSTTELLAGASGTGQSMIFDSINLSIN

SEQ ID NO: 349 - protein, 583 aa, Giardia intestinalis
MCIAIGADNVCTDCGKTGEVPINGKCVAFGTASDKCKKVDDKALDETDTTCGKCEGTTFMYKGGCYETSSSSGAKMCKEAASGICTKTADVKNYFVPPGADATHDSVVWCGDAEGVTLGNSKKYTGVNGCTTCNQPEQATDAPKAAICTACGGGKLVKTAKDQTTSCVTEEECANEEGFFVNANSERKCSVCADTCKTCKTDAVGCTSCTGATPYLKKDDGSETGECVNRGNCPATHYVDEEAKTCTTCTSGGVKDCKTCVKSDGGAVCDTCDGEKPLFGLNKKSCVAQCPENSSNQGGTCACKEGFRPDAESTGCQPAGKCATPGCEACDNGGTENEVCTECSSTNYLTPTAQCVRDCAAISGYYGDSADKRCRKCSPECAECVGPANNQCSACPAGRMLQYTDANTPAYGGACVDQCSAGATGEGCEVCGARIGGTDYCSKCTGAGRVSINGVCSENGRREAACSSLQEGVCRACGAGYFLFSGGCYETTRQPGKQVCAQADGGQCRTCANGLGAQDGDCSKSACHPTCATCTAASQADKCSACPAGYYLDAGKACASCTEASGAIQGVANCASCAAPSGN

SEQ ID NO: 350 - protein, 539 aa, Giardia intestinalis
MLVGIISVLAVILADACSPVKPGCAECDSTGKACTKCDAGGATPYLKKADPSDPTGTCVTVLGCAYDNEHYADNSISSSGTKECKVCNGGKRPDTAGTKCVTCSDANCKRCDQDNVCARCNTGEPPENGACPVTEKGCHSSCDGCTSNAMTNQADKCTGCKGDNYLIVVASNEKSGVCVSAAACTFDGLYFTKEVTDSNGSKKMCLPCNDATHGIADCKKCILKTPSAQAEPTLTCSDCDTKWLSPLGDACLDGCPDGTYSGRNNDNIGICAPCHNSCASCGGTNAETSCTSCYPGAVLSRTNGDTGKCIPECTGGFTAHCKAGGCSLNVGGSKYCDQCEDGYAPIDGVCTEVSSTARDASGCKASGGKCTTCSGSYALLSGGCYDTNRVPGNSVCEMASAGQCTMCVSTNKDPKGSPCPTCSEGCEQCAADTNQCEICYPGYYRTGTGKCFKCAANGDNGIKGVPNCVSCAPPAGGSGSVTCYVKMDGTSGGDDGNGGSVNRSGLSTGAIAGIAVAVVIVVGGLVGFLCWWFLCRGKA

SEQ ID NO: 351 - protein, 803 aa, Giardia intestinalis
MPLSSLFLMLIYLLGGISSEETSIYRNGFGTLCREAVQNCLYNKCLQKSSNTFLCVECESGFVPINGKCVSTTIETVQKAGCVTLSASGWCTKCGQDYFLFYGGCYEWTGDWKISICDRAENGVCKDCGKGSITSRALVFTNPNMGSPERCIYCGDTIGFGGYSGISGCLFCTPSRLKQSTVADCYACLDQQNTCPYDHQCRRVNEGAQRGTCGYCLETHLWSAYSCYAINTPAGNNICLPKNVMKMYKRSLCTHCTNSSEVPYNGLCVPEAGYRNICTKNPNTGVCTKCSDRGRTQHYLFYGGCYIHILDPICQKVENNVCVQCKSDNQEVFTKENGCWRCGDTQHGGIEGCQRCEMKDETLQCLECNDLYLSLDKKNCLEKCPDGQIGTFSPSTSIHTCTCDNGFYLEDENCIKCVIDNCAKCDKSACNECMYGYALFNNQCKETRCQDPNCEICESKTLCIKCISTHSLDQNGLCVKDCLSSAGYYKDIVGGVSRCVKCTLDGCATCESADKCKTCKNEFYLESQEGCKPCSSECATCSSSTTGDCTSCPAKRRLQYSDDTKGSCVSQCVKDNSCAECGLTIDGTSYCSQCVKSTEYPRNGVCTSTNSRATGITCTTVVDGQCIVCGSSSFRLNGGCYTSTLLPGKAVCTTESNGWCDSTVAGYGITYNGTLRTCPENCKVCTDGSCSSCNRGFYPENGVCNACPEGCATCPHGRACFDCLAGYYFSENICKACHKAIPNCNLCMVPEDAVSPVCLDHSNTPRKSALSAKAISGIAIGAVVVVGTVAAVLVWLFVFRKKN

SEQ ID NO: 352 - protein, 689 aa, Giardia intestinalis
MLLIALCFMLSALAEGCQEHGDHVVTCQVNKCEIVNSIEICTECKAGGVPIDGFCWPASSPPAALAGCVPGASSGVCTRCSSEGYFLFMGGCYKAGSTSSQTLGDSICETIQDGRCTKCKADGNVFQNKADSPALGSECILCSDTTGANKNTGVANCLKCTAPDSKEGAATCSECAAGTYKSPNGDTCTACDSPCKTCTAAGINKCTSCIAEYYLKDENTCVNSGGCGGNSYADELTMTCKACTTVHEQCTACSFDKAKGKPKCTDCGSNNTPRTSLDGTSTCVAKTIEGCQGAGTPTAKEVFMKQDQTCALCNDNSVSTPGSQGTLNCKTCTKSVSGTNPVCDECLEGYMKNSGNTCDACHSSCATCSLQDDKTKCQTCKTGFFLKGEAPNECILCNDTTNGGREGCSVCSNDSGFKCTDCKTNYRKKGSSSDDYTCEKICEDETACGGTAGACDATVVDDQGNTKHYCSYCGEDNKFPIDGICTTEKGTNTCISHTCGSCAAGFFLYMGGCYDVSKAPGNYMCKIVGKEGICTEAANNKYFVVPGATSTEQSVLACANPLGTLAGGNAYVGVDGCSQCAAPDARSDGGMAVATCTACGEGKKPSKNGNGCVLCSVKDCKSCKADEKCEECSSGFSLENDKCVSAGASGGNKSGLSTGAIAGIAVAAIVVVGGLVGFLCWWFICRGKA

SEQ ID NO: 353 - protein, 710 aa, Giardia intestinalis
MLLVALLFVSSTLAADCQPDGDHAATCQTGRCEAVGSSEICTQCRAGGAPIDGFCRPVGSPQVIAAGCTGPEGAPLDSTAATYGTCGGADHFLFMGGCYSQKNRMEGTICTKTVEGKCTTCKVDGRYLFQNPANPATPGNECVLCSDIRGDGTTKGVENCAECTKPNAAGVATCSKCKAGYAKKENACVQCGEGCSECSADTPAQCTACFDGKYLSTDKCVDANRCGDGNYADPKTNECKACITAECATCIYNTIIDREQCIVCNNDPIKMVKIEANGETTCVDKATCATDNTPGSHFLSTNSQKCILCSDNSDADNQGIDGCSTCKKKTPTDALVCTECLAGYIKKGSDSVTCEPCGANCATCTQIGDDQCTACKPGYFLKSGRSPSECIPCDGEGGTEGCGICSNDSNTFKCTDCKPNYHKRAGGGSAVTCEKFCEDSTACGGGTAGTCGAIVVQDTGDFLHYCSLCGDPNTFPINGICTGTKGDNTCANGVCTQCAAGYFLYMGGCYSAANTPGNLMCKTAEGGKCTAPNENNKYFLVPGAASNQQSIMACENPLGTAVGEKAYVGVEGCDTCTAPAPLTEAGLRPARCTACNTGSGKPNLAGSGCFLCTVGGCSHCSANGVCEACMNKEQRPNTAGTQCISCSIDGCTRCSAENKCDQCGDGYRLEGEACIATKPSGGNRSGLSTGAIAGIAVAVVVVVGGLVGFL

SEQ ID NO: 354 - protein, 590 aa, Giardia intestinalis
MGGCFKKGSTSSQTLGDSICETAQDGRCTKCKADGNVFQNKADSPALGSECILCSDTTGANENKGVDKCTKCTAPGGKTGTATCTECAAGSFVSNQACTPCDSPCATCETAAGRCTSCEIGKYLKENQCVEKRECTGDHYPDDTTMTCVACNTLGGCTACEIDPVTARPKCTNCGSNKQKSEPNGTITCVEEAKCAEDKVHFLNSDKSKCMLCSDATDSSTPGNKGIDHCNECAKTGDNTNPTCSGCLEGYIKNGDGSMCESCGSNCATCSEKTANDKCLTCKAGFFLVVAGSSKTCVPCNDTGNGGIDGCAECIKEPAGSLKCTQCKPDHTLTGSGCQKSCEDTTACGGTAGACDAMVIDDQGNEKHYCSYCGDKDKFPIDGICKTNSDKGANICTGHTCGSCAAGFFLYMGGCYDVSKAPGNLMCTAAPAGICTEAANNRYFIVPGATSTEQSVLACANPLGTLAGGNAYVGVDGCSTCTAPAGRNDGGMAVATCTACGEGKKPSKSGNGCVLCSVKDCKSCKADEKCEECSSGFSLENDKCVSTGASGGNKSGLSTGAIAGIAVAAIVVVGGLVGFLCWWFICRGKA

SEQ ID NO: 355 - protein, 641 aa, Giardia intestinalis
MLLIAFYLLLSVLAAACSGSAQTNCVENECTQVGATVICTQCQTGFVPINGDCKSKTDSATNCKKADDSEADQICGKCMGANFFLYKGGCYEKAKAPGNIICSDEASGGTDGICTSCNTANGFFPNLAPAASTKQSCIACNETANINGLTGVSGCVACTNIGPAGQTDPKPATCTKCESTTLKYLKTVDGVTTCVTENDCDKDNQKKFFIVDNAREGGKCISCGNKDGAADASNGIWKGVEGCVKCTKSVAAGSATCTECAVDLYLKTDSGATSCVNEAVCKESNTHFPTTNSDKKICVTCDTTANGGIDDCEKCTLKTVSIKTSPIITCSKCKNRWLSPLGDACLEKCPAGTYSERGTDNVGVCAPCHNTCAECDGNAEATSCRACYPGFVLSYGSDKLKGTCIQECTGKYAENCEANQCTAVVGGSKYCSKCKTGYVPVDGICVSATARAIEGCNPGNDGTCTTCKEAYFKESGGCYRSTAFPGNELCSVASDGKCTTCANGQTADKTSGSCPACDSTCKTCTEANKPDKCSTCPPGRYFDSTAKACKLCTEDSNDGKIKGVENCLSCKEPANSPGTVICYVKKDGTSGGGGDSGSGGGSTNKSGLSTGAIAGIAVAAIVVVGGLVGFLCWWFICRGKA

SEQ ID NO: 356 - protein, 393 aa, Giardia intestinalis
MLLVAFYLILGTLGARCKGHQHSRCAIGKCRVVNGNEICTECRATEEKPINGICKSEGNSVVTTNTRHGPQCTEEKCSTPNCKDCTNPKADNEACTECNNGNCLTPTSQCVLACETLGAYYADSNNVCQPCDPSCASCLGTDKTKCTACPAGKALKYTNDEQPEQGGACVDECRADADGCAECGATIGGTKYCSRCGASSDYPVNGVCRTTPGRASTAACKTPDNKGGCTVCAANYFLQNGGCYKTDRQPGVQVCITVTPDGKCETCANSRPADGTGACPSCDPTCKTCTDASDASMCSSCFVGYYQVGTKCVKCDVTDSGITGVSSCLSCAPPPGNTGPVLCYLMKDDGTGGSVNKSGLSTGAIAGISVAVVIVIGGLVGFLCWWFLCRGKA

SEQ ID NO: 357 - protein, 576 aa, Giardia intestinalis
MLCVGVTLAVALGMACSPGGDYAVTCANDKCELVDGIEVCTECKAGGVPIDGFCWPVSSPQVITAGCTKEDGASLDDTATTCGTCSGAGHFLFMGGCYRRRPGAIMQTPDPVLCPEAASGSGNCKTGKCFTIEGFDKLSYCSQCADNTEVPLNGACERPEETQACIQMSGGICTQCAKQTFMYKGGCYPKITIPGVKMCKEAADGVCTSPAPGYFVLPADDRDASHQSVVSCGDSEGALGKSAKIYKGVKGCAECTLSDSATTATCNKCSDKNLSPLKDECMENCPAGTYLDSTGSDGNVCRLCHESCASCEANNASTSCKACYSGYVLNRDAGNKGTCIPECTGKYAENCEANQCTAVVGGPKYCSKCKAGFVPVNGICAPTTPAGREATGCTPSENNDGTCKACTTTYFLESGGCYKAGTFPGNTLCTTANDGKCQACANGQKYTSEGSCPSCSDGCASCTGTPTARTQECQTCFAGYYFDGVAKVCKKCSETSGTITGVKNCISCAPPISGSGPVICYVKKDGTSGGDSGTGGSTNKGGLSTGAIAGIAVAVVIVVGGLVGFLCWWFICRGKA

SEQ ID NO: 358 - protein, 1073 aa, Giardia intestinalis
MLCVGVTLAVTLGMACSPSEGRTMTCKSGNCELVGDAEICTQCKAGGVPIDGFCWPVGSPQVITAGCTGLEGAPLTSSDGVCRKCSGTDHFLFMGGCYNKGTWPGSEICTAVDKGICTTCNTQDTYLFQNPANPATPGNECVLCSDVTSRDGVVGVASCYTCTAPGGGSGAATCTTCQPGYYEEGGKCKECVAGCIDCTGIDQCTACEDGKYLKTNTCVDASGCDETEYADKKTWSCKACSDIEGCTECTYNDTTGKPKCTNCNGKLIKTTVDGTTTCVDANGCAQSNQAGTHFLSNDNRKCIPCGDDSESLEADKGTPGCKTCTKNGAKPTCSECLDGYYNSANSGTATCEACPGKNCATCDKSTKDKCKTCTPGFFLKDSASGECIPCDDTKNGGSEGCSVCSNNSGFECTDCKPNYYKRTRGRSAVTCEKFCEDSAACGGTAGTCGAIVVQDTGDFLHYCSLCGDPNTFPINGICTGTKGDNTCANGVCTQCAAGYFLYMGGCYSAASAPGNLMCKTAEGGKCTAPNENNKYFLVPGAASNQQSVMACENPLGTAVGEKAYVGVEGCDTCTAPAPLTEAGMRPARCTACNLGSGKPNLAGSGCFKCNIPTCSHCSANGVCEACTSKEQRPNTDGTKCISCNIDGCTRCSAENKCDQCGDGYRLEGETCVQIQPSACKTLGNAGCATCDPNGGDEICLTCTKESDFLQLNKKSCKASCDGDGEIADPTSTPKVCKCDAEKGYQLQDDACVQTQPSACQTENCQECTNRGKENEVCTECISTHYLTPTNQCVKDCTTISGYYGDADKKCKRCHDACAECVGAANNQCSACPAGRALTYADDNHPDNGGTCGDACTVDENGCKACGAKIGGTDYCSKCSADSQAPLNGVCTANARAQFCTQVTEGSCTSCNDGYFLRDGGCYETTKQPGKQVCTQANGGQCQTCANGLETQDGDCSKSACHPTCATCTAASQADKCSTCLAGYYLDASRACTLCTETSGAIQGVAGCVSCTAPSGNQGPVLCYLLKGGDSTGGSTNRSGLSTGAIAGIAVAVVIVAGGLVGFLCWWFLCRGRA

SEQ ID NO: 359 - protein, 430 aa, Giardia intestinalis
MQPISNNIGVALCFECSSRSLYPIDYQCQAKGLHNCINGYCTSCYKTHLFHKYGCYSRYSSTGLAVCAEANQYELDNVTICTECTNASYAPRNGACTLVREDAPIGGVFFDCTKDPARGLCTACSSSTPSFLFYGGCYDKNSYIGPKLCPKIGSNGCEEWNSQYPFIFPKDTAKKDHYLCGDAANGGVAGCATCSYSNNAVTCTRCSTGYLGVDGRSCGKDCSGSTQGACSEVVEESSSVKILSCRCVCKPTFYNNSGTCASCTDSCAVCKDGTPTGCQQCSPGKILNFSIASSESADCINQCVVGSECAECGLAIDGSKYCTRCKDSSMYPFNGVCILDAKKDAYCTAKANGVCTTCSSSAFLMNGGAIQHHTIQAIPSVIQSRVVSAQQPGRGTGYQMMESCSPAPPSAWSARPLAPAAAPGAPLGSS

SEQ ID NO: 360 - protein, 678 aa, Giardia intestinalis
MLFAVLYLALGTLAAACQPDGDHAVTCQTDKCETVDSTEICTGCKAGGVPIDGFCWPASSPPAALAGCVPGESSGVCTRCSSEGYFLFMGGCYKAGSTSSQTLGDSICETIQDGRCTKCKADGNVFQNKADSPALGSECILCSDTTGANKNTGVANCLKCTAPDSKEGAATCSECAAGSYKSGNTCLACVKDCISCTADSQCTACKPGTYLKDNTCGESTRCAGTEYADKNTWSCKACSEIKGCTKCTYNENLQKPVCSSCTTGGKTIIKVKLDGTTMCVDAAGCATDNVDGSHFLNQAKDKCLLCSDDKTDASNPPNKGLKDCRTCKKENAGANPVCSECLPGFYLDGTCKPCGANCATCDRSAKDTCLTCKAGFFLKSSSPGECVACNSIENKGLEGCSACSNSGGFKCTDCKVNYKRQSKGEAPDDFICTKVCEDETACGGTAGACDAVVIDDAGKELHYCSFCGDSSKYPIDGRCNSAKGSNTCDNGVCTRCGGDYFLYMGGCYKVDQQPGNYMCSNAAAGICSAANVNNRFFAIPNAQAAQQSVLACGNPVGTAVADKAYVGVEGCSQCTPPTDPAANGMMVATCTACEAPKKPTGNGVGCAVCSDANCRHCRVDGVCEECSSGFSLEGGKCVSTGGPNLSTGAIAGISVAAIVVVGGLVGFLCWWFICRGKA

SEQ ID NO: 361 - protein, 726 aa, Giardia intestinalis
MITSLHTSLHTSLVLILATVITRASIVAGCASDSDCGGVSDSCTITINDLKYCSKCATEQVPINGVCVSKTDAQGNVCSATGCTKCTKGYFLHYGSCFNISIDSPGSLVCDFVDDETEQLADGYCTQCNQNGYTDNPKKSSTAQSCIACFESDGAAGCNLCTAVPDDSSTGGFVLICHGCADKDKVAIDNKCVPIGGVEDALSGCVHSMSSGYTYCNRCGAGFLQFASTCLLANGKYAPKICEVSNQIHVADTICCKQCKNTDLAIIDGDCSDFSFMCTCNGGQCTQCADKKFVYHYGGCYHVYSTLARSICSGEVDVGGRCLQCNTSAASGLFTNPIANEMQACVSCSDTTRQGIANCVECSYAQSKLTCTKCSDGSVPQNNQCSAVTPPGPPEGGCNILACKTCNTTDTTRCAVCHMRTYLALDNKTCVSNCSTQDSGDNHYYGNSATGACEKCHSSCKTCVGPGENQCTDCTPEHYVPGSVGNCISCSSTQPNSAFTGIPNCVRCHKGGYTMTELKCSACVTGMVPDFNQVKCISSTVCSTANCELCQSSPSTCDRCQESFFLTSDGACVSDCTILGPYVGNTQTRRCIHCGEGCISCNSDLHCTSCQSTYAIVDSRYCFKCDSTDSSSLITGISNCIKCKAPSIGHGSVHCLEYNSQPQNEAGSRSNATGITIGVTVAILVIAGLVGFLVWWFVCKKKTNKVSAPPKLSGNSSIIGSRIGLM

SEQ ID NO: 362 - protein, 1615 aa, Giardia intestinalis
MLKVLLVLAVCLAAPCGNTGYECGDHGTCMLVGEVYRCVCAPGWTGYDCSRCSRGFVNLVENCIPPSCIEDGLECGGRGTCLYLKSKDAWECGTCPVGFYQYSGRCVSSYCYGDEEASGVTTERPCSSQGICIFNGASEADRVKPSMYICSCNLIHTGSQCQNCDPQFGKIDPFLRTCVAKSCYDGEDTEPCQGRGECVENAQLHPFTGELTTGYICRCGYPYLLVGTAKCLPLNCVSNQAGTATECGTGGVCEENGGQFSCRCRSGFVQLTDGHCTAPACRPSDGALACSDIGACISGGEDPTDASTYYCQCPISYASGSYCEVCDNQRGTTVDGKCVAKSCVVDNTVCSGNGECVSEGLFAYYCKCHEGYEAHGTNVCAEPGCWDPIVNRTCSGAGQCTSNGCQCNSGFALRSLRCIPTRLISSGWICSGNGTATVSSSDVDASKPENWVCQCDGVVKGELCNECNHERRPHAAYMINGVCTAAACVSDPMASTPVICNGVQGATCKQYGVDVDSIFYCKTPDKSEYLVAYNSSLVVHRGCTYPSQTKYPLNLYCGLLDGRTMDIDEPGAPQCLSTITSSCSCEDPFNFVAVEDTIRNEFGDVQYRTSCIHKACLNPDLKGTTDKQVLQDPSSYCNGLGDCLQDEHGNYECVCGAGSTSFKNTCVSNACLTQDSNTGATVMCGGTGTCAIGTYGHWECFCEYPYFGSGASCYPIGCGYHNPLDCTTVLCGGEGRGTCVANETHPELATCACNRGFTLISSNYCAPSACTAYGADRDDVEPNLSYICSGIGECFYNPVTGSYGCHCGEGYYATGPYCTLPQCLVIIDATGVLPGYIGDLYLECGFAGAGTCSSDGCTCNNGYVKTASLSMCVHAGCIDENNIYCGGDHHAACVDKGDGTGFSCVCTAQYVNVDGACAPKMCVTKDVNGKDVICGGRGHCIQMWTGYMCACDNGGPAVVFEGSYTCPHPDCYEQVGEGLVICSNQGSCKETANSGVCICNNGYSLVGKSQCIISECVQTDGNGVTSICGGGQCLSTNDIYSCACANGFSNVDGRCVHSNCIDTYEGEQIECSGFGKCTAVDSSYKCVCSIGYSPGTEPNRCFSVACLSVIGDKNYECGGHGKCAYSEEQEEFFCTCESGYKNINDDSAGYSVMYLCVASACTTTSGAGQTVCSGGGSCDPTSGLCVCDEGHTGDTCADCADGYIRPPEEYIFRQCMKTTCADSTCGGAGLCVPSLLYNQMVCSCADHHTPLNGRCVPCAIDNCETCDVSQLGRICSVCQDGTYLSDDQTQCLPCHADCRTCQGPRNTQCLSCTEGKVHSLNGMGESGCKEECKVNVDGCKSCGAVISKTKYCSQCQSQTSVPVNGECKSQATRASECSRYSKGACLACADGYFLYEGGCYETAKLPGRDVCSMASGGSCSYCKIGYSKVSGVCTACKDENCATCSTMAVCDNCKSGWSLVDGKCVSCAAECGSCKQGSPSMCESCKDEYFASFSFSGDVSGPCRPCSDTTPKDGVVGVPGCRYCTLPLTSGTNENPVSVICLTTESADKKMSTGTIAGITIVILLIVGGAVAGVLVWFFLFKNRKGPIRKSPRKRFHPDETSTSLLSQDYGSSML

SEQ ID NO: 363 - protein, 750 aa, Giardia intestinalis
MLLVALYFAMSTLAADCQPDGDHAAICKSGSCEMVSGAEICTQCKAGGVPIDGFCWPVNSPQVITAGCTGPEGTLLDSTATTCGTCGGADHFLFMGGCYSQKNRIGGTICTKAVEGKCTTCKVDSKYLFQNPANPATPGNECVLCSDIRGDGTTKGVENCAECTKPNAAGAATCSKCKAGYAKKENACVQCGEGCSECSADTPAQCTACFNGKYLNTNTCVDSNQCPSGTYADSYSGKCETCAAGTSGGSDQTIAGITDCTICSLDEANKRLVCSGCGGGKLLKTDATGATSCVDSGTCVTDYFSEGSECVLCGNEEKGGVAGCKSCSKKDTCTACLAGYFDSGTPKCTACSENCLTCNNADAGQCTKCKPGYFVQGGGTGTCTACGANCATCDEAGDDKCKSCKIGFFLVGSPKGACIVCDDKLSKGIEGCSKCEATGPGNPPKCTSCKDNYHHEPGSAGAVTCKKFCEDPTACGGTAGACEAIVVQDNGDFLHYCSLCGDLKTFPINGICTGTKGDNTCANSVCTQCAAGYFLYMGGCYSATSAPGNLMCKEAPNGVCIAPSENNKYFLVPGAASNQQSVMACENPLGTAVGEKAYVGVEGCDTCTAPAPLTEAGMRPARCTACNSGGKPNLAGSGCFSCTVGGCSHCSANEVCEACTNKEQRPNTAGTQCISCNIDGCTRCSEENKCDQCGDGYRLEGEACIATKPSGGNRSGLSTGAIAGIAVAAIVVVGGLVGFLCWWFLCRGKA

SEQ ID NO: 364 - protein, 583 aa, Giardia intestinalis
MFYTLLWIGLVLQLVRATQAEEKCTEVTGGEANTCKTCGAIIGGVSYCSQCNDSGSTSAPTDGACTADNNECTQKEGGVCTQCAQSSFMYKGGCYKTANGPGNMACEAAQDGKCTTAKAGYFLPPDADRDNAHQSVIPCGDEEEITVKNNHKYKGVPHCIQCDAPTAASDANAKAATCTACEDGFFGATCEACQDENCATCAVTGSNKCSKCKTTGTKTYLKVDSGSTGTCVEASACTGATFPKVDQQGNKCAGCNSVPDGGIDKCATCNLLTQGSRVTPLVTCLTCEQSKYLTPEKNACLDACPAGSYATGQACTPCDPSCAECSGAGASRCTACPAGKMLRYADEGKLNEGGQCVEGCVEGPECEACGLTIGGTKYCSKCKGSNVPLNGVCTSNAARAQFCTTAADGACTVCAAGYFIQGGGCYKTDRLPGKSICTTDNGGKCQACANGQNPDGGTGVCPLCDSTCKTCTAGQTQQCQSCFSGYYKSGTKCVKCDASDSGITGVSGCVSCAPPSNSQGSVTCYTKKDNTDNGGGDSGNGESNTNRGGLSTGAIAGISVAVVVVVGGLVGFLCWWFICRGKA

SEQ ID NO: 365 - protein, 805 aa, Giardia intestinalis
MLSLLASFLLGSSCGISADTYRNSFGAECKKHTGSCARDRCLFIGHEELCTQCIPGYVPINGTCQQLGGGSSVCIPDDASSPTRCVECRPETGAFLFYGGCYTVDQSAIGGDICLQAAGGRCTECNTDADGRHVFANPDAGAAERCILCSDTVGFGGYRGVSGCLDCMQPISNNIGVALCTRCNYAEKDNGIGPIDYQCQAKGLHNCINGYCTSCYKTHLPYSGGCYSRHTATGFAVCAEANQYELDNVTVCTECADTSHAPRNGAYTLVSASGSLFSDCTKDADRGLCTGCSSAGKSFLFYGGCYDRSSHIGSRLCSEVAGGACKQWRSSFDFTFSKAGGTERYLCGDANNGVHGCATCRYGNGVECTRCSAGYLGVDGRSCGEDCSGNTQGACSEVVEESSSVKILSCRCVCKPTFYNSSGTCASCTDSCAVCKDGTSTGCQQCSPGKILNFSVVSSESADCVSQCVAGSECAECGLTIDGNKYCTRCKDSSTYPFNGVCVPDAQEDAYCAIYENGVCTACSEAAFLMSGGCYTTAHYPGDTICDKQAGGKCTTTKEGYGISADGKLQPCDPTCLECKAPGPGRCTKCPSGKLLRRAPAAATGSCIEPGACADGYYADGDACLPCVVPGCRACGRTSFCTECAGELFVGLDGRACLRECSGDRVVGEVSGGTRRCWCERGFAPALDRSGCVPAAECPPGTPWCASCDESGRCLSCAAPGHNIQVDQRTCAEGCGDRAAPDQGVCVCETGTVLDKDACVPINALTGRKMMVVTTSAAAAVLVIGVLAGFLCWWFICRGKRRCYR

SEQ ID NO: 366 - protein, 823 aa, Giardia intestinalis
MGIALLPLIAVCLLAGVFSQEAPIYRNGFGYSCANIASNCLPNSCILDLSGGFLCVECSPGYVPINGRCTSANADQAKAFGCVKSSQGWWCTGCGANHFLFYGGCYEFSQSWKASICDRAEGGICKDCGKGDTVYAPIVFSNPNTTTPERCIYCGDPVGFGGYSGAYGCQSCKQPRLPGKTEFDCEICLNISTCPFDYRCESVVGVSVFGYCERCPKTHVWSASACYAIGSITGDTICLPRNVIDIKGQSLCTQCANSSEVPRNGRCRPSSGFEDVCIKGPKIGRCESCRDSNAIKHLLFYGSCYQFGGSAENLIGSYICQKVQGNICIACNSSTKEVFTKNNGCWRCGDTANGGIAGCQRCEMKGDALQCLECRDLYLSLDKKSCLAGCPRGQKGVRDPSSSIHSCTCDDGLYLKDGGCVKCAVENCAKCNESKCSKCRYGYTLSNDQCAETKCKDPNCDACENRNVCTKCSNNYSLDQNGLCVKDCLGSAGHYKATVGDVSRCVACTLGGCAVCESADRCKTCRDGFYLESQEGCKPCSSECATCSGPEAGDCTSCPAKRRLQYSDGTKGSCVPQCVKDGSCAACGLTIDGTSYCSQCVKSTEYPRNGVCASTGSRATGITCANAFGGQCITCGPSSFRLNGGCYTSKLLPGKTVCSGERDGWCENVAAGYGITYNGTLLTCPEHCKVCTDGSCSSCNSGFYPENGVCNACPEGCATCPHGRACFDCLAGYYFSENICKACHKAVPKCSLCAVPEGATQPVCLEYGRSPRPALSAGAISGITISVVLVVGAVTAVLVWLLVFRKRAGVPPLYKQSTVASTQ

SEQ ID NO: 367 - protein, 636 aa, Giardia intestinalis
MFEKVLFASLILQVAQGECQDTGGPTKCASGKCDVWLNGVKYCSQCSVESEHLINGECVANDSDNNCESDTKGGCTSCKTGYFLYEGGCYTINAEPGNFVCEDQSASGTAGVCGACKAFNGFFKNPDDAAKQSCIACNRTEPLGTVKGVADCIQCSPPPGSLGTREDKVAVCSRCKDEKYLKTDGTCANDSSGCTVFTEFAKADPENGNKCILCGDKANGGVADCETCASKGTRIAETPAVKCITCSSEKAPNGDGSACVDVPGPSPSDCPVENCQKCSADKKTCEECKDKNYLTPTKMCIDRCEYITGYYSGTEGGKRVCKKCEIANCIACNEEGKCVTCKDGFYGEVCSLCDSSCKTCGGSAANDCTSCKSGTVLDYTNGQKGRCASECAVNTDKASGNCKTCGLTIDGTRYCSACSQDDEYPQDGVCAPKASRIDKCKDETIKNGVCDMCADGFFKMNGGCYSTGQLPGSMVCSNALGTGGTCKTPVEGFSLTGNSLVACYTGCAECTTTEDCSRCMDGYVEVGKVCTKCHESCNTCESDAVTCKICAFGYYKESDSNGPCKTCSEGLAGCRQCTMSSANAFVCFEMGDNTSENVNRGGLSTGAIAGIAVAVVVVVGGLVGFLCWWFLCRGKA

SEQ ID NO: 368 - protein, 418 aa, Giardia intestinalis
MLVVVFLVCVTVLAKCSGATCVPNADGCAEALTTAGCATCTAAGPDQTCLTCSPPNKVRPDKKGCIAACPETVSTENGEFCECTDGHKPSPDGATCVPNACNTPSCKTCNNPETDNEVCTECNGDSYLTPTSQCVPDCTAIGGYYGDSADRKCKKCSSECAGCVGPASNQCSACPAGRALTYSDASHPGNGGACGDACAADKNGCKACGARIGGTDYCSHCSDNAQAPLNGNCATSSARVAFCAAMGAGVCTKCAANYFLQDGGCYEATRQPGKQICTLATNDGKCQTCANSLQPNNGVCPLCHSTCKTCSAADTASACTTCATGYYMVGSAAGACTSCEADSGSVKGVSGCLSCAPPSGNTGPVLCYLTKDDSTGGSTNKSGGLPPGAIAGIAVAVVIIVGGLVGFLCWWFLCRGKA

SEQ ID NO: 369 - protein, 424 aa, Giardia intestinalis
MLLLVLCFALSTLAVQCRGSQHSSCAAGQCKVVRGVEVCTRCRAGHVLVNGVCTGNSAGYEVVSGCPVLNCAQCNEDGRTCDRCDDGYDLSKEKTECTKVPEQQCNTPNCKACDNPRTDREVCTECSDGNYLTPTKQCTQSCGTIGGYYDGDKTCEPCDPSCVACTTKGPTKCTLCPPGKRLQYTDEGAPQGGGSCVDECKPEGGAGGCETCGATIGGTKYCSKCSTSSEYPVNGVCTADNARASACKVKDGKGGCTTCDNGYFLQDGGCYKLGRQPGEQVCTVAGNDGQCQTCANGLEAQAGDCLRSACHPTCKMCSAADASTACTMCATGYYKIGLDAGACTSCEADSGSVKGVSGCLSCAPPSGDTGSVLCYLTKDDGTGGSVNKSGLSTGAIAGIAVAVIIVVGGLVGFLCWWFICRGKA

SEQ ID NO: 370 - protein, 842 aa, Giardia intestinalis
MYVLLGLVLLSIGFLCIDIDSESSPFENSIDSKDPRVEALVLVTCASDANRRTCALGMCLNLGSAELCLKCVPGLLLIDGACVGQDSYEVAFAGCEIDPESYACLSCSSLKYHVYNGGCFGAASGIFEFAEPPERGSTPTCEEVISFNMFQTVPGKCKQKHCNIDLGGNKYCSRCSVKSEYLVDGKCLSSTNNGACTSQDSPDGTCKSCGAGYFLYKGGCYSITHGAPGNLICKEVDTAPGVCKLCQDGFFRLPEPAADRHSCMLCNDTSEYEYDVPDSYYDVRTFTGVKDCRKCSFKGEVTTSLNKPVCEACHSDYYLLSREDSAMCLSSQECASTYFRKTVDGTNLCVFCGDTSRGGLDGCSKCTYAANTEIVTCESCLLYQYEKVVNNVLTCVSLDECTAPYYPKDSDDADNIWDKQCLLCSDTTKNGIQDCTACTYTSTGLKCIACSGTKKPNAAGSMCYDCNIVNCEECSSSMVCSRCAPGYIISSSACIVDPSPCSVLGCKTCVSGNKQLCSVCQEGFYKDGTTCRKCATGCTVCSGAGAQCTSCEQDRFLLKSGSSDSGSCVTACGDGHFEDTTLKVCTRCSNAHCKRCAGPSFCTRCNDDMYLKLTPSSTECVSGPQCYTESFPQEDFDRGNKCVPCGDNLVGISNCVECTLDGGLLSCSKCKSGSLLDLFRRTCVTQCPQNSTPKEENGAMACICEDNYAPSDDGTLCEPTKPCPQYQGCARCDSLDRCVQCVDASDNIQLDNMTCQRSCPSGATVKRGRCHCMGGQVPSGNACVDPPNNSASKLSTGMIAGISVASVAIVVVIIGCLVWFFLRKKSSGSSTREPSLFRPLSS

SEQ ID NO: 371 - protein, 143 aa, Giardia intestinalis
MLLLVLCFALSTLAVQCRGSQHSSCAAGQCKVVRGVEVCTRCRAGHVLVNGVCTGNSAGYEADSDCQVDNCARCAQGKPAECEECNPNFDLDNGTKQCVSSSINKSSGGLSTGAIAGIAVAVVIVVGGLVGFLCWWFLCRGKA

SEQ ID NO: 372 - protein, 589 aa, Giardia intestinalis
MFIESLLVGVILQSCLAGQVSSGTCEEATSGEETGKCAQGKCDVIIGENQYCSQCSTPTEFPIDGICTTEKSTNTECTTGGKCTSCMEGYFLHKGGCYSIAPEKPGHILCIEAINGVCTQGADGYFAVPGALKTGESIVTCSDSTTGVTTSSGTYKGRANCEKCEPPPDVMGFRTDRLARCTRCTESRYVKTDGSCAEDANGCISGTEFGKVDVQNGNRCILCSDEINGGIADCNTCSKREDIVACSACNGAKKPNKAGTGCFECPGKDSTANCERCSADNACEVCSNNNYLTPTNLCLANCDGLPGYFMDTEAKQCVSCSKDCKECTGKATQCTACSPGRMLAYDKEGAYPYGTCVDQCVVAEGTVPGTCGTCGAKIGGTAYCSKCNVAAEVPVNGVCETNNARNAPCAEADNAGGCNRRADGYFLFERGCYKTDKQPGMQVCSDATGINGLCKTCANGLPADNGNCFAQKCHPSCKTCSTAGDASKCKVCADGYYRETAGGTDGECKPCSQGKPGCTLCKHSGAGFTCLSTDPFNGDGDDTKPVDPSSSNESSLSTGAIAGISVAVIVVVGGLVSFLCWWFICRGKA

SEQ ID NO: 373 - protein, 836 aa, Giardia intestinalis
MIFVLLLLLSGVFSECTADNECGGDGGVCDVTISGKRYCSKCAGSDAKARVPINGKCRLLSLSRSICQVPLSNDPNPGTCTGCIRDFLFYRGGCYRTAALINAICKEKHIIEEGMYCGACGIEGDVPINGVCVAAGAESSGNTCDKGVCTACTAGYFFHYGSCYKFGESPGSIVCPNQSDTTGSVCGSCGPKFVKNPNASSSATSCLACYGLDGTLFCDECRISVLTGEGAKPTLCTRCKSGHVPIDGRCVSAYSATAALAGCSDVSTRGLCETCSSGYMLFYGSCYSVDGPIAQAICATENQIYLGGRVFCRQCAQTDHYPIDGLCIADKGSHTCADGVCTACDTSKTTPLDNSKVFLFYGGCYNASSAIGSLICLDASNGACSTCNTTGTSNVIANPSSADGQPKCLACWDGAATGVANCGGCAATTEGDSKIVCSKCTDSTEPKDNACPQALPPATPEGCAVQGCQACSKDSATACDACLPPLVMKEDRTKCFGSCLALGPGYYNNSGTCSPCMEHCLLCADGATCSQCDEGYYLALSSTNPPQGTCRACAAGCSACNDGTDTGCTACLPGYYIASESKANRAAKCVLCNTTEGGYTGIPNCVACFSTVGNNGAKNVVCSQCEEGYVKKHDGSQTICEPPTPECNVAMCSVCADNSPDRCEHCTTGAYLCPRTAACTKDCASCGGSMYPDGDLGECQPCDIPSCRVCATGLKCKSCAENAVPISPDVYHTACMGCSDTGGMDGWVGLAGCTTCELTDRGGGSVNCLDPGYYRRGGLGGGAIAAIVIAVLLALAVAGFLVWWFVFRRGRSSRRGGAKYTSLVRGESYDYRQSLI

SEQ ID NO: 374 - protein, 824 aa, Giardia intestinalis
MPGFPSVLLLAFLSGASADTYYNRFGVACKDGQTDCAQDRCIPVGSRQACTQCKPGYVPIDGRCQGYPGAAPSPCAPDDPVSPTRCVACSQDGTFLFYGGCYSIGQPSSGSMGGLLCSKASGGKCTECKKDASGSYVFTNPDTGAAERCILCSDTVGFSGYKGASGCLDCLPPITEKVGTALCARCHYTNEDRHHYPIDYKCQASGPHGCINGYCTSCYKTHLFYEFGCYSRRSSTGLAICAEANQYELDTVTICKECANSSYAPKDGKCTPIENGVSSGSSFSECTKDKDKGLCTGCSDSADYFLFYGGCYNRHFVPGSKLCSAVASGACTKWNTKLNLLFEKSDKNGYLCGDAANGGISGCATCSYASGAVTCTRCSAGCLGVDGRSCDEDCGGDTRGERPGLAGGSSSASASCRCVCKPTFYSNSGTCTKCTDSCAVCKDGTSTGCQRCSPGKILNFSIASSESADCVSQCVVGSECAECGLAIDGSRYCTRCKDSGMYPFNGVCIAEPAQRDAYCTAKANGVCTTCSSSVFLMSGGCYTTNTYPGNTICDKQADGKCTTTKEGYGISADGKLQPCAPECLECTAPGPGRCTRCPSGKLLRRAPAAATGSCIEPGACADGYYADGDACLPCVVPGCRACGRTSFCTECAGELFVGLDGRACLRECSGDRVVGEVSGGTRRCWCERGFVPALDRSGCVPAAECPPGTPWCASCDRSGACLSCSAPGHNIQVDQRTCAEGCGDRAAPDQGVCVCEIDAVLTRGACVSAKEVARKRVAVIAGGTMAGVVVVGGLVGFLCWWFLYRGKRAGAFSSTTALVRPKSM

SEQ ID NO: 375 - protein, 633 aa, Giardia intestinalis
MFYTFLWIGLVLQLVRAEGECTPVTSEDPSTCKTCGAMINGKEYCSQCNDAGGTTSAPTDGVCTTDNAVCNPKAEGKCTTCTGNSFMYKDGCYAIAKEPGKSMCGAADAGKCTQAKAGYFLPLDADRDATKQSVMSCGSDEEITAGNAKKYKGVLHCKECRQPDSNAGGAAVPAICTACEDGFFGAACEACHSSCLTCEATGETKCKSCRDGYFLGATGGGQGKCVSCGDTSSEAWKGVDGCLRCTTSGSANTPATCNECQEGRYLKDGGSAGCVLKDACTGTHFPNDNVEGKKKCLPCGDRANGGIENCEECSLLSPVSRSATALIKCSKCGSDKKLSPLGDACLDNCPAGTYTSSSGNICKPCHTSCAECTAYTTGENSCTACYPGFVLSKGDADSTGTCIPECTGKYAENCEATKCTAVVGGSKYCSKCKTGYAPVDGICVSTTTREPTGCTPGNGVCDACTGTYFLQSGGCYNAQTLPGKMLCTAANAGKCQTCAATGQNAAEGKCPECSEGCAKCADSNACTECYSGYYKGAGNKCFKCTSGDNAVNNPITGVADCISCAPPTGGNGGPVTCYVKADGTSGGDDGTGGSTNKSGLSTGAIAGIAVAVVIVVGGLVGFLCWWFICRGKA

SEQ ID NO: 376 - protein, 2529 aa, Giardia intestinalis
MLVAIFGLVLSCTHGNQPGECAAGKCTILGDRYCSECATPGEVPINGVCIPYNDPRVVASGCASEAGKLLKNFAKTCSSCVEKNYFIHEGGCYNILYSPGNLICAELTGNVCKICSLDYYLDTQVTPPTCKACHAHCNSCSGSSENQCLSCPPDRFLDGSLCKKCSDKPYGIGNCRSCTMNIDGSLKCLSCQEKYYLAGNQCLTCPNNCAICTGATPNECLLCIDNYSYDSQTHTCILTCDKSKVAKSGKCAEDGCTAFRNKFCAKCSLDTEVPINGVCTSNDQNICLHISTSSGTCDSCKKGYILFQGGCYHVDTELGLKACAYTISIKDATFCANCGTPGFVPINGVCVPYNSPSVVASGCRDSVGGLPTLASIRCTSCGKSYFLYQNGCYSPESAPGNVICNEVDKAGKCRLCAYNYFRSRGDCIPCHSNCASCLGPNANDCTSCTPGIFFQVFSMGKGMCKYCNDILVQYDNAGIAHCAKCLPLPRGQRAQCTVCENGYLLIDNHCEMSCWTDGLAPGSCKPDHCNIFSSALCSCCANDNECPINGQCTSALIGAKVVSGRCTECPPRYFPYEGGCYEKGTTIGLSICKDVDNTTICSVCASGYTRTRSECRPCNIKHCINCDGGVDTCNSCAYSYQLQKNKGKDSCVKACTEELIPGGCIYGGCVVRDKTFCERCSVEYEVPIDGVCRPLQEDAPECAIMEGGRCQRCSKGYLLYYGGCYNTIKPVIPICEKEHTITGYGFTYCKKCTLETEYPVNGSCTTEAYGNTCKGGVCTGCGAGYFLHRTVCFTPDFYPQICIKAKAGVCEVCGPTYYLNPVRSSTIQSCIHCSDVDGIFGYTGVAFCKTCLAPLISGAGHCTSCLNRYLLVNGICEESCPLSSDSLQPISGKCAVGFCNVLGATFCSKCALSTDALIDGKCTSVDMENVCKKSDVPNGTCIGCAGLFFYYKNGCYNPKTYPGNAICNEYAVMDGVTYCFRCSILSDLPINGHCVPMSDSKSSPCVLARIPNGQCYYCVDNYFLFKGSCVSADIAPGNALCKSIGSNNGICDICKEGYYASPDRSSVSDSCLLCTEDNGTLKGIPHCKSCKVSNGLLVCVVCEELYRPMNGGTECVQTCVEAEADPKEHRCKKGKCDVLGTFYCSQCAADAEAPVNGVCAPVAGGICIPYEQANGTCKYCTHGYIKYRGGCYETGSLEAEDICDAQDVVTSGAGSFCARCKHKDEVPIDGECKVSDDCTVKEDGICKSCKQGIKSFQIAKDGSSTTVACFTKCPDGMYESAEFCHICDKSCKTCRDSSTKCTGCAGGFYLAAERCVACGVPHCLTCSAADTCTSCQDGYYADGNSCTACTPGCKNCDGTGCKVCKDRFALDNNACTEACPIGLLFTSCAAGYCNVNGTLACSRCALLSSVIIDGKCKANDDACIRTVPSSGTCAACKDTHILYYGGCYDKSTAAGTAICDSQHQAMLGPYAVCKQCKRDGEVPIDGSCAALTDTKAIRSQCVAAASSPTSCTRCGPGFFLHAGGCYELGRSPGAVLCAVAADSAVAGVCTSCASGYYSTGLLDPTKESCILCNNTSETNGYTGVDGCMECYPSEAPRRVICTRCGDKHIPNEDGPQCVQSCNDSGSESGRCKAGGCTAMDSLYCSRCALDYEWPINGACTARDTDYVCEKGKGVCTGCLRGYMLYMGGCYDPAAIPGSGICKELLTIGGRTYCKWCNIANEFPRDGLCTKVMPQGVLCLNGLCVVCPEDYFLHEGGCYSITTAPGSEICEVLGTGREAGTCRQCRPGYRHNKETLTCMPCTISNCASCEIDVDYCTECIQPYTLTGVGAGAYCAKVCKRVGQDACSWSSCTVMDGSLCSQCASSDYVPINGVCTLYPGDARSLAGPCVKDAAKGRCTACRGNYFLYQGGCYSASEYPGTGICDERDATVLEGQVVCGRCLIDGEVPLDGTCAEPQEGLICSKGACSRCGEGMFLFEGACYTKGRAPGTSICGDTAKLTSGCAACEAGFSKTDKGCVRCSDPNCGACGGDPNTCTACRAGYYLQSTSCIVCHSACRTCDGAGADKCKECADGYFGTFVAPGPGTCLACSDTSGRDGWVGVSGCRLCDAPKVAGLALCRDCLPGYKTLSTGTGVTCHAVCPVAYYEAAGSCLPCATDNCATCTNTACTSCVPEHIWNGEECVLEVCPAQCLCKEQSIACTGCRENAVEVRPTHSSASRCLLCSDARAGGGWTGVDGCQRCRLADRVGPVVCLACESGHKTLALDGVLLCPGDCPADGFWTSGSECIPCAAGCLRCTSTTACSMCSQGYYSTQSAVSAPSDCRPCDDATSHNGFAGVAHCAVCTADRARAAITCHACAEGYGLSGGSCSPCAVAGCARCDGGVCTSCKRGWHLAGDRCLACLSPCAACSSATSCLACADGYFQATPLGGPQDCVPCDQTAPQGLQVAGIYGCGLCQAQAGSSTILCLRCTNGDLPLENYCGGPSTGRRLGPGAIAGITLGIVVLVGGSIGLTFILVVSKNKSQANGLRPLTA

SEQ ID NO: 377 - protein, 682 aa, Giardia intestinalis
MLLITLWFVLNTFAADCAQKSNTQNCVQGKCEVIGETEICAQCNQGNVPINGECVGAEGAKAKCTTAEGDGNQASDQTCGKCLQQTFMYKGGCYDTTGIIGQTICKTLGGTAGKCEACNADNGFFTNPDATSTIDSCISCGDAAGITIGKDNNAKTYKGVSGCAKCTAPKQLSQAAGTAVAICTECTAELYLKTVAEITSCITIENCNTGFFPMIDKENENKKLCTKCSETNKGGIADCNECIPRTDDPTKGKCTACTGDKKPNLEGTECNVCTGQNCAFCVSGGACEGCSSGFILDGENCVKSDCKTENCKACTDPKAAGEICTECISTHYLTPTSQCVQYCQVLGNYYDGANADNKKTCKECTIANCKECTDKGQCQTCNDGFYKNGGACSPCHESCKTCSAGTANDCTECPVEKILKYTGDKGACIPQCVVNAAEASGNCKACELVIEGTKYCSTCSKSDEYPQDGICTVKAARVATCKDGSITSGVCKQCADDYFLMNGGCYEAGRYPGKAVCTAAQVGGTCKATADGYKLDGGTLTACSEGCKTCTSDSICDACKNGYVKVSNSCKACSTGCATCNTNPETCTACLVGYYQSESKCIACDKDDSAIKGISNCLNCVPPSSNTGSVLCYLMKNDGTGGSTNRSGLSTGAIAGIAVAVIVVVGGLIGFLCWWFICRGKA

SEQ ID NO: 378 - protein, 803 aa, Giardia intestinalis
MTTLASLVLILTYLLGAFSSDEESIYHNGFGYSCNSRVSNCLPNKCIYLREVPYCVECDSEYVPINGKCVSVKSVTSTGTGCVKSSAGGWCTGCNDGYFLFYGGCWVEDTQKSIICRRAEKGLCKECVTESLASVFTNPNTTAPERCIYCGDPIGFGGYNGVYNCQNCRQPRLPGTTEADCYGCLQQEMCSFDYRCKPAGDIASFGYCTICPKTHVWSDFACYAIGGATGDSVCLLENIIEIQNRSLCTRCTNPLEAPQNGRCLSISKFDNICVKDPEKGQCTSCQDRDAEKYFLFYGGCLRKDTSYQIGSQICQEVRDNVCTMCKSSAEEVFTGNNRCWRCGDSANGGIDGCQRCKMGSDGLQCLECRDLYLSLDKKSCLASCPRGQKGVRDSSSSIHNCTCDDGFYLKDGKCVKCAAENCAECDEASCKTCKYGYTLSNDQCVETKCKDPNCDICEEKDVCTRCNNDHSLGPDGLCVKDCLSSAGYYKDTVDGVSKCVACTLDGCATCESANKCTTCRNGFYLESQERCKPCSSECATCSGPEAGDCTSCPAGKRLQYSDDTKGSCVSQCVQDGNCAECGLTIDGTSYCSRCTKDTEYPSNGVCASNGSRVANIMCTVISGGQCIVCGPNSFRLNGGCYTSTLLPGKAVCTTESNGWCDSTVAGYGITYNGTLRTCPENCKVCTDGSCSSCNRGFYPENGVCNACPEGCATCPHGRACFDCLAGYYFSENICKACHKAIPNCNLCMVPEDAVSPVCLDHSNTPRKSALSAKAISGIAIGAVVVVGTVAAVLVWLFVFRKKN

SEQ ID NO: 379 - protein, 236 aa, Giardia intestinalis
MLLIVLHFVLGTLAEACDGGAAVGCVDRGCETVGTVEVCTTCTAGKVPINGICKAHDDGETTAAAGAGCEKKEGGVVDGTSTTCGKCTSANYFLFRNGCYDATKGVGKTVCTAANNGICTAPASGYFVVPSPDAVATEQSVFSCSDTTGVTLTGNKKYVGVANCATCSAPTEDERVAKCKTCNDKFSLEDNQCVSSSTNRSGLTTGAIAGIAVAVVIVVGGLVGFLCWWFICRGKA

SEQ ID NO: 380 - protein, 719 aa, Giardia intestinalis
MLLVALYFAMSTLAADCQPDGDHAATCKSGSCEMVGGAEICTQCKAGGVPIDGLCRPFSASHAATAGCTKNDGAVLTGSDTTCGKCSGADYFLFMGGCYNKGTWPGNKVCTAADKGVCTTCKVDGKYLFQNPVNPITPGNECVLCLDVTPRDGVMGVASCYTCTAPGGGSGAAACITCQPGYYKEGTGCKKCVAGCIDCNAASQCTTCEDGKYLKTNTCVDASGCAETEYADKKTWSCKACDPDVTGCMACEYNDATGKPKCTNCNGKLIKTAVDGTTTCVDANSCAQSNQAGTHFLSNDNRKCIPCGDDSESLEADKGTPGCKTCTKNGAKPTCSECLDGYYNSADSGTATCEACPGKNCATCDKSTKDKCKTCTPGFFLKDSASGECIPCDDTKNGGSEGCSVCSNNSGFECTDCKPNYYKRTRGRSAVTCEKFCEDPTACGGTAGACEAIVVQDNGDFLHYCSLCGDLNTFPIDGICVKEKSGNTCENGICTQCAAGYFLYMGGCYSAANTPGNLMCKTAEGGKCTAPNENNKYFLVPGAASNQQSVMACENPLGTAVGEKAYVGVEGCDTCTAPAPLTEAGLRPARCTACNTGSGKPNLAGSGCFLCTVGGCSHCSANGVCEACMNKEQRPNTAGTQCISCSIDGCTRCSAENKCDQCGDGYRLEGEACIATKPSGGNRSGLSTGAIAGIAVAVVVVVGGLVGFLCWWFICRGKA

SEQ ID NO: 381 - protein, 721 aa, Giardia intestinalis
MFGRFIFTSCILQLAWIIQTTAAACTPGETGSTKCKTCDAIIGTERYCSECDQAGEGPINGVCTSTKNGNTCDNKVCTQCAKNYFLYKGGCYKFGEAPGNTICEDAVDTVGGTDGVCTTCKAANGFFKHPVPAETKQSCIACNETVGVVDGDTTYKGTPNCLKCNSPSNAIRAKTDKIAVCTLCDQTKYLKEGTCVEKVDCGTNMFGKPSVQDGNKCIECGNSDVGIESCAECTVSDEPSNKPTCTKCAGDNYLKTTDEGTSCIHKEHCTEAYFPNDSVDNKKQCVLCGDVINKGIADCTACNLLSSPSETVLIKCSACMNGKKPNEDGSSCIDAPEPSPDECTIKGCQVCSEDKRTCDTCQSNNYLTPTKMCISDCKNLGNYYAIIEQTKKICKECTMNNCKECAESGKCEICNDGFYLLDEECKPCNDTCKTCEGGMEADKCTSCKSGSALIYAGNGNTGTCSFGCTPKTGTDPGSCKACDLTIDGTRYCSVCNVGKEYPQNGACAGIRTRASSCQDGNVNNGVCSKCEAGFFLMDGGCYEITKYPGKTVCTKTAADGTCETPAPGFSLVSNTLKACFEGCAKCVTGDDCSECINGYVSGSSPNTCEKCSIGCAMCYPTATTCTACLAGYYKSGPKCIACDKDDSAIKGISNCLNCAPPSTDSGSVLCYLMKGSDSTGGSTNKSGLSTGAIAGIAVAVVVVVGGLVGFLCWWFLCRGKA

SEQ ID NO: 382 - protein, 194 aa, Giardia intestinalis
MLYLIVLILFGLAFAANPVPKDCAGNGRPSCASGKNCLDVNVAGQQKEVCTKCENTHVPVDGTCETIATAGAKCTPKGSPDGTCQSCGEGHYLYRGGCYTTCPQGTPNPETNTCDGVPAPDCNIPNCKSCPDGTCTECNDGFVLGDGNKCVASSVNKSGGLSTGAIAGIAVAVVIVVGGLVGFLCWWFICRGKA

SEQ ID NO: 383 - protein, 409 aa, Giardia intestinalis
MLIAVLLIYTTALAKSVSEAACDPPIVGCATCTGTGDGQTCLTCDPSSNKVRPDKKGCVAQCPANSNDVGGICTCAETYQPSEDGLTCVLKAACNTPNCKACDNPKADKEVCTECNGGNYLTPTNQCVPDCTVIGGYYGDADKKCKKCNSECAECVGPASNQCSACPTGKALTYTNGEDPTQGGACGDACTVDKNGCKACGAKIGGTDYCSQCSVGTQAPLNGVCTANARAQFCTQVTEGSCTSCSGGYFLKNGGCYQADRQPGKQICTLADSKGGCETCANGLPPSSSDVCPSCHPTCKTCSVASNPDKCTSCAAGYYMVGLNDGTCTSCERDSGNVKGVSGCLSCDPPSNSQGTVLCYLTKDDSTGGSTNRSGLSMGAIAGISVAVVIVVGGLVGFLCWWFLCRGKA

SEQ ID NO: 384 - protein, 419 aa, Giardia intestinalis
MFAKLIFISLILQLTEATRPAGRTRSEGECTSLGAAGCATCSTGDNGETCLTCENPDEFIQLDEKGCKPACNAEGEVEDSAAVPKVCKCNEKGGYKPQGGKCVKGSEGECKTENCQECTNKGTANEVCTKCISTHYLTPTNQCVPNCTTISGYYGDNADKKCKKCNSECAECVGSANNQCSACPAGMMLQYTDASIPAYGGTCVGQCSVSATGEGYEVCGARIGGTDYCSKCKGSQVPINGVCAANPSARAPACTSNGQGVCTGCTGDYFLRDGGCYKTDRLPGKSICTQAANGQCNQCANGLQAQGGACGACHSTCATCSAADAAEKCKTCATGYYKTSDNEGSCKKCSEKIPGCKQCTSSSAGSVICLESEAGTGGSTNKSGGLPPGAIAGIAVAVIIVVGGLVGFLCWWFLCRGKA

SEQ ID NO: 385 - protein, 827 aa, Giardia intestinalis
MLGFLWVLLPASLCKDSRDTYYNSFGVVCNDTQTNCAQNKCFSIGSWTPCVQCVPGYVPIDGKCQEYSKTASSPCIPDDPNSPTRCIRCTSTENIFLFYGGCYTITTTQDKNLGDFLCSEASNGARTECKKDASGSYVFTNPDTGAAERCILCSDTIGFNGYKGASGCLDCLSPITDKIGIASCTRCYYTDKNKRLYPIDYHCQASGPHTCRDGYCTSCYKTHLFYEFGCYSRRSSTGLAICAEANQYELDTVTICKECANSSYAPKDGKCTPIENEIFPSNSFSECTKDKDKGLCTGCSDSANYFLFYGGCYNKHFAPGSKLCSAVASGACTKWNTKLNLLFEKSDKNGYLCGDAANGGISGCATCSYSNNAVTCTRCSTGYLGVDGRSCGKDCSENTQGACSEVVEESSSVKILSCRCVCKPTFYNSSGTCASCTNSCAVCKDGTSTGCQQCSPGKILNFSVASSESADCVNQCVVGSECAECGLAIDGSRYCTRCKDSGMYPFNGVCIAEPAQRDAYCTAKANGVCTTCSSSAFLMNGGCYTTAHYPGDTICDKQAGGKCTATKEGYGISDDGKLQPCDPACLECKAPGPGRCTKCPPGKLLRRAPAAATGSCVEPGACADGYYADGDACLPCVVPGCRTCGRTSFCTECAGELFVGLDGRACLRECSGDRVVGEVSDSTRRCWCERGFAPALDRSGCVPAAECPPGMPWCASCDGSGACLSCAAPGHNIQVDQRTCAEGCGDRAAPDQGVCVCEVDAVLTRGVCASTRDAAKKKTAAIAAGTTAGILVVGALVGFLCWWFICRRKRASFSSSCTTLIPPSKPM

SEQ ID NO: 386 - protein, 654 aa, Giardia intestinalis
MFIKILWISYIPQMIRATCQDSSGCKPESCNVRIDADEYCSECKAVGSYIVNGKCDPANTENACTAKHEALGYCTSCTAGYFLHKGGCYKFGEPPGSSICSDAAPGVSGAVPGVCSVCREGYFKNPTITAESQSCISCSETTAVDNVNGIAKCVACQAPIEAGNSSPNPAKCTKCESGKYLKVTDDSTQCLDDPSACGEGYFGKEDIPNGNKCLICGDKDNGVVGCKTCTNSGSVQCQTCLDGYFKTSNTECTLCNENCLTCKAEAAKCTSCKADTKPYFKDGADGDQTGTCVDETECKGDHFPATDTGSANKKVCVPCGKADKGGITNCKTCAFKVSSTREGPAITCTECATDNLSPLKDECMAACPAGTYANSNVCAPCHKSCASCQANDKETSCTACYPGHSLLYGVGGATGTCIKECTGEFGANCADGQCTADVGGAKYCAQCKDGYAPIDGVCTEFKSNTRNLPECSPKNGKCTKCTGNYALLSGGCYNTQTLPGKSVCKAVANSNDGKCKTCANGQTPDPATNFCPLCDSTCAECSTKNDADACTKCFPGYYKTGNKCIKCTESSNNGKKIDGVPNCLSCEAPANAGPVICYAKADGNNTGDDDGAGGSVNKGGLSTGAIAGISVAVIIVVGGLVGFLCWWFLCRGKA

SEQ ID NO: 387 - protein, 504 aa, Giardia intestinalis
MLLVAFYLILGTLGARCKGHQHSRCAIGKCRVVNGNEICTECRATEEKPINGICKSEGNSVVTTNTRHGPQCTEEKCSTPNCKDCTNPKTENEACTECDPTHVLDGGNCVERKCSTPNCKDCTNPKTENEACTECDPTHVLDGGNCVERKCSTPNCKDCTNPKTENEACTECDPTHVLDGGNCVERKCSTPNCKDCTNPKTENEACTECNNGNCLTPTSQCVPACETLGAYYADSNNVCQPCDPSCASCLGTDKTKCTACPAGKALKYTNDEQPEQGGACVDECRADADGCAECGATIGGTKYCSRCGASSDYPVNGVCRTTPGRASTAACKTPDNKGGCTVCAANYFLQNGGCYKTDRQPGVQVCITVTPDGKCETCANSRPADGTGACPSCDPTCKTCTDANDASMCSSCSIGYYQVGTKCVKYDVTDSGITGVSSCLSCAPPPGNTGPVLCYLMKDDGTGGSVNKSGLSTGAIAGISVAVVIVIGGLVGFLCWWFLCRGKA

SEQ ID NO: 388 - protein, 699 aa, Giardia intestinalis
MLSAPWIASSMFDRIFFGIIILQATQAAACQVQSGGSGGTCEKCDAFIGQVRYCSKCNQPDTYAPVNGVCEDVETQEDKKTLCKAHADGTCTTCGGNSFMFEGGCYSSGEGLPGHSLCLNSDGNGVCTEAAPGYFLSPLKANNKVSVVSCSDTTGITDTHTYKGVQYCDRCDGSQLTSSQDGTAECTKCGENKYLTTAGTCGEGCTPDTEFLKEDLNNGKRCFACGDVTNGVANCEKCTAPSLDQAKPICTKCGGNKYLKTAADGTATCVEQNTCTVDSFPVVNAQNGNKCVLCGDVQGAADDSGSTWKGVDGCSRCRKSSSAANPAICEECAVEYLKVESAEKTSCVTSTNCNTGFFPTTDSNDKKLCTRCNDDAHGGIADCSVCSLLTLTSRSSTILIACSACVGKKLSPLNNECMTACPAGTYDDSNVCRSCHDTCSSCYNNANADSCTTCYPGYVLKRDETNTKGTCIKECTGDLVAYCKSGGCTLDVGGSKYCDQCEDGYAPIDGICTKVSSTARDASGCKASGGKCTECGPTYALLSGGCYDTQKLPGKSVCTAAQNKGQCQTCANGQAYAGGNCPACTEGCVKCAGNKDTCTGCLAGYYLSNSKCFKCDADDSQVTGVSGCVSCAPPAGGNGPVTCYVKIDGTNGGDDSTGGSVNKGGLSTGAIAGIAVAVVIVIGGLVGFLCWWFICRGKA

SEQ ID NO: 389 - protein, 600 aa, Giardia intestinalis
MCPKYYWRRAFMRENSLEICRPSAIKNPMLGLLSLLFAASFCRVFTDQYHNGFGIECGQGHEHCLLNRCILIGSAKVCTQCKSGYVPIDGVCRPYSKGASSVCISEGPLSPNSPSRCIDCRLGKSMFLFYGGCYTQDRSSIGGYICSRASGGMCTECNVGAQGSYVFTNPNISAAERCILCSDTTGFSGYRGVSECHSCAQPVGSGVATALCTKCRSPEQGGDLGPIDHQCQAKGPHDCRAGVCLSCYKTHLLHQSGCYSRHSTTGTAVCAAANQYVLDNVTICGECADASYAPINGACTRVQGGTADAEPHDCTQGRDKGLCTDCAGSAESFLFYGGCYGKGSGTGAKLCSAVASGVCTEWKRQFDFIFSKDGKSGGYLCGDAENGGISGCATCSYGDGALTCTRCSSGYLGVDGRSCSEGCGDGARGVCAGTAEGSEPAGWACRCVCKPGLYNNSGACTSCADSCAVCKEGVPDGCQRCKPGKVLEPSVVARETARCVDECTAGGECAECAIAIDGSRYCTRCRDPSMYPLNGVCLAGAREDQYCTSRGDGVCTACAEGAFLMSGGCYRTGVYPGSVICSVQSGGRCKETKKGYEMSD

SEQ ID NO: 390 - protein, 428 aa, Giardia intestinalis
MLIGLLLVCVVVRIHCTSELDKANHKTCTRVASVVDECPIENCQTCSGDKRTCEACKPGFVANGDNTVCSPAPDECPIENCQTCSGDKRTCEACKPGFVANGDNTVCSPAPDECPIENCQTCSGDKRTCEACRSGYFLTPEKNDCLISCPGGSYATGRTCTPCHSTCSSCSDATENSCTTCYPGSVLSRNGGKATGACIPECTGGYAENCEATRCTAVVGGSKYCSKCRTGYAPVDGICVSTASRAPAGCTPGDGVCDACTGTYFLQSGGCYNAGTFPGNTSCIVASGDGKCATCANGQDANPQTGSCPSCPANCSKCSGNSDAKTCTECYSGYYLDVGKACKKCSETSGNIQGVPSCMSCKAPSSPSAPTPVTCYVTQQRTDDGTGGSTNRSGLSTGAIAGIAVAVVIVVGGLVGFLCWWFLCRGKA

SEQ ID NO: 391 - protein, 495 aa, Giardia intestinalis
MDKQSKECKACSTAIPGYTACTYEDSIGGPKCSDYGSKTVRDELDGTTTCVDETECKKDKTHFYEASKCVQCGDNTKQGVQNCKLCTAKNTCETRVDGYKVNGNTCEACTGNCAECGTVGQIDTCTKCMPGYFLKSSSAKICVLCDAQTDRILGCTECTSDIGSLKCTKCKPNYKQSGEPGDLTCTKVCEDKTVCGDTAGACDAMIINSDGSALYYCSNCVGAGYGPINGKCTNTLVSNTCANGICTRCTNDYFLYMGGCYQATTQPGSYMCSTAPNGFCTTSVGQYFKIPGDVATHPSVLACGNPVGTIAGDKAYVLDCTACTAPQAPAVNAMAVAVCNTCDKTKKPNQDGSGCTLCTVAECKSCITDDVCEVCENSKKPNKACNACYACSIADCSHCSADNRCEVCADGGKRPSLDGTQCITCDIDRCTRCSAEDVCGECEAGYAPKDRKCEPGSTGLSLSTGAIAGIAVAVIIVVGGLVGFLCWWFICRGKA

SEQ ID NO: 392 - protein, 596 aa, Giardia intestinalis
MGGCYRTGSQPGSEICTAAEGGKCTECNADNGLFKNPAAAPDAGRECLLCWDTTGANGYKGVDKCTTCETPDKEGAATCIECRDGYFWDNSVKTCQACDEKCETCTNTGATNCKTCKPGTYLKGAQCIDGNSPKCDAGTYADSKSNKCMPCRIENCATCEYLDKINGPKCLTCNEPSTNLLKTEIDGTTSCVVAAKCAVASQPGTHFLSDSNDKCILCSDDKDGTETNKGTPGCRTCTKSGAKPTCSACLDGYFFESGSCVKKCDQSCKMCSAATDATKCESCYPGYFLVESTEPPGKKCVPCDDANSGGREGCSACSNTGGFKCTDCKANYQKEGSQDNYTCKKTCEDVTGCGGIAGACDAAVVDGSGNTKHYCSFCGESSKFPIDGVCVNTGSENGNTCKNGVCTQCTTGYFLYMGGCYSVSTAPGSHMCKTAGEGICTAPSEGSRYFVVPGATNQDQSVLACGNPVGTVTGNKAQSTKAYVGVDGCSQCTPPTDPAANGMMVATCTACEAPKKPTGNGVGCAACSDANCRHCKADEKCGTCNEGFSLEGGKCVSTGGPNLSTGAIAGIAVAAIVVVGGLVGFLCWWFICRGKA

SEQ ID NO: 393 - protein, 1137 aa, Giardia intestinalis
MFAALGLLIASQAAKCTHSYQVSDCAEDRCEEINGHELCTECRNAGYIPFNGYCLKYDSEQHSSCRNADGTPITSQTKCGMCTDSMHLYKGGCYSCGDLYPGNLICRECGKGVCTSCTSNFFENPAASQTVDSCIRCDDTIGVSGVVGVAGCLRCFPPSDPKDSNVARCSACKLATHKPNLKGTACYKCDIPDCVRCTTDDSCAVCGGGYLQGTTKRVCVSECGVGFYIAPTQLRQCKECSATCRTCEGPDGTDCTACHGSEGYFLATKGGTGKCISCGDEQGYAGWRGRANCKTCTPPSTPGVVKCTECEADYSLIDGLCEATCGDPNEECEPDGCNAAWRDYFMCSRCKEGYAPINGMCAEITPNHLSVCVPNKGRCEKCGLHYFIYQGGCYDVEFEYHKFVCLETGTKPEEIGLCKTCADGFQNDGGICVRCQAPYCKTCTQDTNICESCLDGYHDPSLCKRCHDNCKTCVGEGPERCLTCPSGKYLSPIYKNIGVCVYASQCGYGMYGDPYSHKCTPCSAGCATCRDSNEDECTSCYLRTHFLVTAEYGRSRCIECGDVTNPRGIDGCRECTMEGDSVKCLACKAGYTLVDGKCQSNCQDPNCAADSCVVGISEKLYCRLCKTDGHAPIDGVCTEVSGAHPSGCVTGVAPDSARSCLQCGAGYFLYMGGCYRENEEPGKSVCSWAGVIGYASNSNYGLGLCNACAPGYENQNGICRPCAMANCEQCHTGTQGEVCTHCMVGYVMDQAGRCSIQATGSCIVPDCAVCADDGKCQSCGPGFFLTSAGTCVNSCRDIPGHYALDATGESPARCALCEIQNCKECRASDSCAVCADGYFSDNGACAPCDSKCATCMARGPDGCTSCPPGYAIASESRVGRCERPCTPSAEGCKACNASIDGASYCSVCSVQTAFPLNGQCVGLSARAGPACASVVDGACKKCADGYFLLSGGCYQVEAYPGRAVCRAEEQGVCTRGAHGKIVSASGVLRECSVANCAECTADACVTCRVGYVHVNGQCQRCAPGCVACTAPDNPQMCTLCDTGYYQSTTGSAFTCTACSAGNNGMTGVSGCTYCVPPEGKTGSVLCYSFDALPNITPTPEPRSIRKTAIIAGVSVTVALLVTGLVGFLLWWFLCRRT

SEQ ID NO: 394 - protein, 494 aa, Giardia intestinalis
MLLLALCFALSTLAVQCRGSQHSSCAAGQCKVVRGVEVCTRCRAGHVLVNGMCTSNSAGYEVVSECAVANCERCNADNVHCDQCAEGFEANSDKTQCTAKCAVANCERCNADNVHCDQCAEGFEANSDKTQCTAKCAVANCERCNADNVHCDQCAEGFEANSDKTQCTKTPEQQCNTPNCKACDNPRTDREVCTECSDGNYLTPTKQCTQSCGTLGGYYNGDKVCEPCDPSCAACATKGLTKCTLCPPGKRLQYTNEEAPQGGGSCVDECKPEGGAGGCETCGATIGGTKYCSKCSTSSEYPVNGVCTADNARASACKVKDGKGGCTTCDNGYFLQDGGCYKLGRQPGEQVCTVAGNDGQCQTCANGLKAQAGDCLRSACHPTCKMCSAADASTACTMCATGYYMVGAGPKACTSCEADSGSVKGVSGCLNCAPPSGDTGSVLCYLTKDDGTGGSTNKSGLTTGAIAGISVAVVIVVGGLVGFLCWWFLCRGKA

SEQ ID NO: 395 - protein, 643 aa, Giardia intestinalis
MDNDSMFGGLIFVFAALQLSWARRATKSLKEVDQCKDCEANSCELVGDAPICTRCSVGMVPIDGTCKAYNNRDVTTAGCKAGGANVGEDATVCEECGTAGAYFLYKGGCYEANRGVGASLCTQAANGYFVSPGAQKADQSVISCSEKTEITVNGRKYTGVAHCVQCQQPNANMGDTAVGPTCQACEDGFFGTTCEACDPSCKTCEGGNGADKCKSCTAETHFLGATSDTLGRCILCGDTSDAAWKGVDGCLKCTASGSANTPATCTECQEDRYFKAKIENTAESCETKESCIGTHFPNDNADGKKRCLLCSDKNGGIERCGECALLSQATRATALVKCSKCTTGNLSPLGDECMLDCPAGTYADSNVCKPCHESCSGCETGNAEASCTACYPGSVLSHDGSEPAGACIPECTGSYAANCEENMCTAVVGGSKYCSKCKVGFVPIDGLCVSTAARAATACVAGEGVCTSCAGGYFLESGGCYKAGAFPGNTLCIAAGVNGKCANCANGQSADPQTGSCPPCPANCSKCSGDSSAKTCTECYSGYYLDAGKACKKCSETSGDIQGVPNCISCKAPASLDVSTLVTCYVKTDGTSGGGGDSGSGGGSTNKSGLSTGAIVGIAVAVIVVVGGLAGFLCWWFICRGRA

SEQ ID NO: 396 - protein, 719 aa, Giardia intestinalis
MFGKLLLAGAVLELAWAACEEDQASTNGKCKTCGVTIGQDTWCSVCIGENYAPINGTCVDVTTDSVGSVFCTQKAGGVCTQCAGNSFMFAGGCYSSSEGLPGHNLCLRSAGNGVCAEAAPGYFIPGETAGTKPSVISCGDKTGLLITTHTYKGVEFCAECSGSELTDGQDGVAKCTKCGASKYLKDNTCVDNAEACGKGYFGKSDVEVGNKCVACTDQSNGGVSGCAECTYDSKTEKAICTKCTTDYLKKKADGTTECVAVGDCDDTQKGFYKVVDPTNGNKCISCADEAGFAVGADGAWKGVDGCAKCTKPENINTPTKCDECKSGYEINTDKTKCTSATPPDCPIENCKVCSGDKRACEECNGNNYLTPTRMCIDDCKKIGNYYYSTNANNKLACKECTVANCKECENTGTCKTCNDGFYKSSEECKACDSSCKTCSAGTANDCTACPTGRALKYGGDGAKGTCGDGCTTGQGSGACKTCGLTIDGASYCSECAVDTEYPQNGVCASATARAAATCKSGNVAKGACNSCTNGFLRMNGGCYETAKFPGKSVCEEAASAGDTCQTEAPGYHLNNNALVVCSAGCKTCTSNTVCTACMDGYAKTGDSCTKCAAGCATCTNTASACDTCSTGYYKSGSICVLCTANNADNTITGVANCASCAPPSNNQGPVLCYLMKDGGSTNRGGLSTGAIAGIAVAVVVVVGGLVGFLCWWFLCRGKA

SEQ ID NO: 397 - protein, 181 aa, Giardia intestinalis
MSLSYEVQCIEEEDGQCIRCPRGYVANQRLNTCVWNRASEPPIICPDGYFLDKGLCTLCHSSCETCTGSAGPNSCTLCARGYYPAFTEASGLCVPCSTSHGVVSGIPGCVHCARDGSSLYCFERRQLKRNLTTIRKALLISLVVLVLALFSSLILIFAGGSKIKHRQRRLPVRYVARHKMV

SEQ ID NO: 398 - protein, 198 aa, Giardia intestinalis
MFDKLIFASLALQLAWASQTASTAKANPASCDPQNPGLASCDADSCNMEIERQTFCSKCTGGKVPVNGECKTTGEAKMCTAGAGPQAGTCTACTGTQSLYMGGCYDECPYGPSENERVCAEAPAGCNIPNCKSCPDGTCTECNDGFVLGDGNKCVASSVNKSGGLPPGAIAGIAVAVVIVVGGLVGFLCWWFLCRGKA

SEQ ID NO: 399 - protein, 1609 aa, Giardia intestinalis
MRTWILTLLMCTCSNRHHYLHNGNRYLRDDALCRLAAKSNTAKRILFSDVSDCPENCISCTDPHICEVCDYGYTLTNRGRCVDLCIEGNSETNCAVGHCTVFDDTLCSKCAHEGDVPAAGVCNTGVTTCVKDSHGVCISCESGHLLYQGGCYPSKSALAQSICATDNQIVVEGMLYCSLCNGENEAPINGHCTDEYSSYCDATGGQCINCIADGYFLFNGGCYDSNEHPGSVICVEVHDNECTECGSHYPMTDGVCTYCPVDHCLLCENESCTQCQKGYVLRGSGRCVKLCSEGNGLQSCAIGHCTAFEGTLCTKCAYEEDVPVAGICTSGLTTCQKNSSQICISCEGKHLLYSGGCYAATGTHGLQICSIENQITIGDKVYCSKCNQGKEAPLNGECTESATDHCDVHDGTCTSCKTTGYFLFQGGCYTLASIPGNIICAEVSGTTCAKCRDGYGIREGECSPCMIAHCLDCKTDVATCNACDPKYFFTGTDCIACEGEHCAACRDNMCVDCTDKTECNACAIPNCVLCDPALTECLACQEAYEPDKNGLCTPLPASECPLSCLCADQDVPALCTSCKPGFIAAGVISGDTCLSCALEVEHCNLCSYLPESDSIVCEECLDGYRLDGGLCEPCGKGCKSCPHRANKCAECFAETPYFNPALTECLAACPPNSVAAANKKCSCIHGYYSTLQGCEMCDESCDTCSGGEVDKCVTCRSGFFLASGSWKGQCISCDFNSFSDGSVIGVEHCIKCRGVQENGDLIVICEDCDLGYTLKGEVCVLDDSGHEDCPSNCICTDESPTCVSCQKGYFTLSTPSAENCVRCSSAVSGCKTCTVEEPLSRRSAKKVTCTLCDDGKGLVEGTCHSCHTTCKTCNNDPQLCSTCYNPTYKLSLRSDQCVPECPEFSEEQNGRCVCLLGYSISSNGLTCVKDNSACPSVCTCVVGNVCSGCADGYFTFDPSRTDAARCEPCSGDFCSSCGRVPNDATSFYHALGSSRRYTHRRSSESVNICIECADKQGCSACSIEGCNRCSTSEHTECTECMPDYQLSQDKKLCIPLVPICPLGCTCVPGTSTCNGCVDGYFEVDPTDEASGRCMRCNIPTRYIPTRISRARRLERLLSLRGKKADSVGLQIARDASWNGVAGCALCTTPSNPGPAICTQCVQGKHLLVSGESTQCLDACPDGMGSVNNVCFNCSDENCLRCDGNLESCAECRSGTSPTLTPDTELVVCETVCPLGCICEDPESSSVCTGCQSGYYEVSVLARLIMRLRKTDVHCKKCLANCMTCTDENTCLACADGYILHQTGASCVEKCDQGYYIKQGQCAPCTGEHCASCTSETTCTSCIGSSFLSGGKCVTCSTSCKTCGGGTEDDCLTCPTGTVHSTGTGLGSCLQECSATAAGNCTVCNAIIDGTRYCSKCTPGEAPINGRCEPVSTARNVACVTSGDGTCESCSANHFLFNGGCYATSRYPGSAVCTSSSNGLCTNCADGFTNTNGICSNCVLGCSSCSSTAASACTSCTEGFFPAFSGSQGVCKQCDDTTITNGYQGVQNCRVCIAPQQAGTALCLDSGEVTNKSSLSAGAITGISIAVIAVIGCAVGVLVWFLCCRRSKAV

SEQ ID NO: 400 - protein, 660 aa, Giardia intestinalis
MRRIDGLVLLLVTVKSMFDKILFGALILQFASTVPEAKASTCEQSSSEEPGKCAQSKCDVVIGGSQYCSQCSKAGEAPVNGVCTAELDGNNCATKICTQCAQGYFLHKGGCYKIGGEVGSLICADTSSPGVRATAGVCEDCKSGYFKNPEAAANADSCISCGDQAGFTITGGSGNTYKGVQNCATCQPPERANPGSSQQKEAMCESCVDGFFGSNNCNQQCTDPCAACKTTATACTKCKPGPSNTKEYFKVTNLVEKTGECIAQDACTDTYFPTTDKAGTKVCVTCNDETNGGIKDCKTCISKDSVGIVKELTLTCSTCKTDTNKPNVVGSQCFVCPNNDSTKDCGKCSADNLCEECSGGKVLTPTKLCLEDCSGLPGYFMDTEAKQCVSCSKDCKECTGKATQCTACSPGRMLVYDKEGAYPYGTCVDQCVVAEGTVPGTCGTCGAKIGGTAYCSKCNVAAEVPVNGVCETNNARNAPCAEADNAGGCNRCADGYFLFERGCYKTDKQPGMQVCSDATGSNGLCKTCANGLPADNGNCFAQKCHPSCKTCSTAGDASKCKVCADGYYRETAGGTDGECKPCSQGKPGCTLCKHSDAGFTCLSTDPFNGDGDDTKPVDPPSSNESSLSTGAIAGISVAVIVVVGGLVSFLCWWFICRGKA

SEQ ID NO: 401 - protein, 829 aa, Giardia intestinalis
MLATLLLLLLVSSYGASTDTYHNSFGVACDNAQENCMQNRCVVIESTSVCTQCIPGYVPISGTCTEYPGSASSICIPDSTTSPTRCVECKDSASEASMFLFYGGCYDMIDESIGSSVCSKASSGKCTECNVGVGGRYVFTNPDGSAAEGCILCSDRVGFGGYRGVAGCLECIQPVDQRLGTPLCFECDSTTLAPIDYQCQDKGHHICSDGRCTSCYKTHLFYNGGCYGRHTTTGLAICAGPNQYELDNTTICTECANASYAPKNGACTLVKKDSTTGGLFLDCAKDPARGLCTACSSSTPSFLFYGGCYDTSSYVGSILCSRIGSNACEEWNGQYPFIFPEDTAKRDHYLCGDAANGGVASCATCSYASSAVICTSCSAGYLGVDGKSCNENCSGNTRGACIEILGGSESTILLCQCICKLGLYNNSGICMPCTDSCAACKDGTPNGCQQCSPGKVLESSVITSGNAKCIDECTTHGSCVECGLTIDGSKYCTRCKDPSMYPLNGVCTTDAQRTSYCTTKANGICSACSEAAFLMNGGCYTTVHYPGDIICISQADGKCTATREGYGISADGKLQPCAPECLECAAPGPGRCTRCPLGRLLRRAPAAATGSCIEPGACVDGYYADGDACLPCVVPGCRACGRTSFCTECAGELFVGLDGRACLRECSGDRVVGEVSDGTRRCWCERGFAPALDRSGCVPAAECPPGMPWCASCDGSGRCLSCAAPGHNIQVDQRTCAEGCGDRAAPNQGVCVCEVDAVLTRGACVSAREVARKRVAAIAGGTMAGVVVAGGLVGFLCWWFLYRGRHTGALSSTASAPLSMRGGTALVST

SEQ ID NO: 402 - protein, 625 aa, Giardia intestinalis
MLLVIFYLVLSALAIACTDKTQNCAEGRCEMVGDTEVCTQCQAGKVPIDGVCVEFGTVAEKCQKTGGQAVDDKDTACGKCLDKYFMYKGGCYDKTGTPGNTICGTGGDTAGICDTCRANYFKHPDPADTKDSCIPCGDVTGVDYNKGIANCKTCASSDTAGTENAPQTATCTECVDGFSPDPTGKTCVAVECAENCLTCTDEAADKCKSCTAETYFLGAASGGEGRCIKCDDTTGANGYRGITNCVKCTQPESAGPAVCTECAANLYVKADVGVMACVAASECGEGFFPATVGGVKKCVSCDETDNGGVETCAKCALKTPVPETGTVVTCSECDGGKKLSPLKDACLNSCPDGTYDKQNVCTPCHSSCANCTDATSAACTACYPGFVLNATAGASAGTCVQECTGKYAENCADGQCTAVVGGSKYCSKCNIGYAPVDGICVSTTARAVEGCNPGQDGTCVSCKDAYFKESGGCYQSTTYPGNKLCSSAQSGQCQRCANGQTPDSGFCPACATGCATCETTNAQQCKTCLPGRYLDSNKACKLCTETSGNTQGVDSCISCLAPTSPNTPTPVICYVTKDDGSGGNGTNKSSNLSTGAIAGIAVAVIVVVGGLVGFLCWWFICRDKA

SEQ ID NO: 403 - protein, 1075 aa, Giardia intestinalis
MLCVGVTLAVALGMACSPGGDYAVTCANDKCELVDGMEVCTECKAGGVPIDGFCWPVGSPQIITAGCTKEDGADLDDTATTCGTCSGAGHFLFMGGCYNQNTWMGRRICSETSGGECTACARADWLFENPAKSPAPGTKCILCSDANGDGKARGVENCVTCQTPGSSPGVATCGICRVGYANRGDACVQCGDGCSACSADTPTQCTACFDGKYLSTDKCVDATKCEANHYADKKTWSCKACSDIEGCTECTYNDATGKPKCTNCNGKLIRTAADGTTTCVDANQCAQNDQAGTHFLTKNSDMCLLCNDVSIEGEAANKGVEGCGTCKKADPSQNVVCTACMDGYYDSDDGPDTATCVACGENCATCVKDTKDQCTTCRPGFFLKAGAPNECVSCDDTTNGGSEGCSACSNDGEFKCTDCKANYRTEGTSDNYICRKTCEDETACGGTAGTCGTIVIQENGDFLHHCSLCGDPNTFPIDGICVKEKSGNTCANGVCTQCAAGYFLYMGGCYSAASAPGNTMCKEAPNGVCIAPSENNKYFLVPEAKNNQQSIMLCENPIGIAVDEKVYVGVEGCDTCTAPAPLTEAGMRPARCTACNSGRKPNLAGSGCFLCTVGGCSHCSANGVCEACTSEEQRPNTAGTQCISCNINGCTRCSEENKCDQCGDGYRLEGETCVQIQPSACQTLGNAGCATCDPNGGDEICLTCTKESDFLQLNKKSCKASCDGDGEIADPTSTPKVCKCDAEKGYQLQGDACVQIQPNPCQTENCQECTNRGKENEVCTECISTHYLTPTSQCVPDCTVISGYYGDADKKCKRCHDACAECVGTANNQCSACSAGRALTYADDNHPDNGGTCGDACTANENGCKACGAKIGGTDYCSKCSADSQAPLNGVCTANARAQFCTQVTEGSCTSCNDGYFLRDGGCYETTKQPGKQVCTQANGGQCQTCANGLETQDGDCSKSACHPTCATCTAASQADKCSTCLAGYYLDVSRACTPCTETSGAIQGVAGCASCTAPSGNQGPVLCYLLKGGDSTGGSTNRSGLSTGAIAGIAVAAVIVAGGLVGFLCWWFLCRGRA

SEQ ID NO: 404 - protein, 419 aa, Giardia intestinalis
MLVGLLLICITVLAKYNGRDACKLKTGVCDGPLTTAGCATCTEAGVGQTCLTCTAPSHKVRPDEKGCIAACPEGVSTDVDGFCECKNGYQPSASGETCELDACNTPNCKTCDNPKTDREVCTECNDGNYLTPTSQCVPDCTAIKGYYGDTDKKCKKCHDTCAECVGPADSQCSACPAGKSLEYGNSIYPNNGGTCGDACKTTGGSTGCKVCGSTIGEALYCSQCNNNNQAPLNGNCAANARTRFCTKMGTGACTQCAADYFLKDGGCYETISSPVSRSVVAHREGHARHVPMDCRHKMETVPSLHVILLVLRAALPVLQARVRRVPLATTRRTVAIPLLGHARGAQRRSLAASSALRHLLVQSYAWSQRQAPVEAPTRMPSPQAPSQASLWPLSSSSGASSASSAGGSSAEGRCRCTLR

SEQ ID NO: 405 - protein, 740 aa, Giardia intestinalis
MFSGFVFVGLIVQLAWAEQAKERAGVASCADDTNNCELCDVLIGDKLYCSKCKASAVGHAPIDGKCADAASKTPCKENADGKCTECTGQSFMYKGGCYQVSQEPGQTMCKTAADGKCTEAPASKSYFVIPETKRQPTGQTVVWCGDNAGVTSGGQTYKGVIGCTTCDGSKLTADASGEAVCSACGNNKIVKIAKDSATSCVTEDDCTGAEGFFVKGNLGSKTCEACAETCKTCKTEAAKCTSCKNDKPYLKKAQSQDQTGECVTEEVCKREGTHYADDSKEPKTCRTCAEGTFEACEACEKSREGAVTCRRCKSQKKVQPNKKGCIDACPPNVSVDSHGICECVEGYVPDEIGTGCKEESAPPAPPVAQCSTPGCKTCDKPKTDEEVCTECEDPKLLTPTGQCIDKCGDLGGYYEGTNDKKKKACKKCEVANCLLCNEKGKCAACKAGFYGEACAACNSACKNCSGPTAADCTECSSGRALKYDTSGAKGTCEAGCKPNASGCEKCELTVEGTTYCSKCKEAGQFPQNGVCSAAAGRAVTCATQGTGVCDKCTNGFLRMGGGCYETAKFPGKSVCADANADADTCKTPVPGYKVEAGKLVTCSEGCDTCNDANTCTKCKDGYVLITSKCTPCSAGCATCTNTASACETCSTGYYKSKNACVLCTANNAENTITGVANCASCAPPSNNQGSVLCYLMKDGGSTNKGGLSTGAIAGIVVAVVIVVGGLVGFLCWWFMCRGKA

SEQ ID NO: 406 - protein, 766 aa, Giardia intestinalis
  misc_feature (600)..(600): Xaa can be any naturally occurring amino acid
MHRQHSWAWCEAELMAGWEARPPDGPQSQRPKDASSQALAEWMTHGEQRRGRRADHRHSDRPECSGGRGPSGILHQELPRNPVDTTMLLIAFLFVSSTLAEACQPDGDHAATCQTGRCETVGSSEICTQCRAEGVPIDGFCRPVGSPQAIATGCTKGDGTALEQTAATCEKCGSEYFLFMGGCYRTGSQPGSEICTAAEGGKCTECNADNGLFKNPAATPDAGRECILCWDTMGANGYKGVDKCTLCEQPNREGAATCTECTVGTYKSLNTNECKVCDNACTTCSGEGENACTLCAGGKYLDGNSCVAKGSCGMDKYEDNASMACIACSTIDGCTRCKLGATGRPECTVCNLDKIPRTGLDGTSTCVTKGYEQCQGADKELFMKEDQLACLLCGDTKEAGNDKGVANCKTCTKSANDSPPTCTACKEGYIIKDPGNSATCEACGANCATCSQAILDTKCTKCKEGFFLAGAGEGKCISCENGNDGGYSGIAGCLSCKAPTNPGPASCDRCKIGYMLKGTTCVKVCEDEKACGGIAGACDATVIDEKGVEHHYCSYCGTDSEAPIDGKCSSAKGSNACNNGVCTQCTAGFFLYMGGCYSTXNPPGNLMCKTADGGVCTEAASDKYFAVPGAAKTGQSVLACGNPLGTAVDDKTYVGVEGCSRCTVPAQLEASGMAAATCTACGEGRKPSKSGTGCAVCSDANCRHCRVDGVCEECSSGFGLEGGKCVSTGGPNLSMGAIAGISVAVIVVVGGLVGFLCWWFICRGKA

SEQ ID NO: 407 - protein, 220 aa, Giardia intestinalis
MNYCSYCGGADDVPIDGRCVNKANANGNTECTAHKCPSCTAADYFLYMGGCYSTKKEPGNLVCTEAKDGKCIAPTSRYFAVPGAAKTGQSVLACGNPLGTTVDDKTYVGVKGCSQCTAPAQLEASGMAAATCTACGEGRKPNKSGTGCAACSDANCKHCRVDGVCEECSSGFGLEGGKCVSTGGPNLSTGAIAGISVAVVVVVGGLVGFLCWWFICRGKA

SEQ ID NO: 408 - protein, 198 aa, Giardia intestinalis
MFDKLIFASLALQLAWASQTASTAKANPTPCDPKNPDQTHCAADGCNVEIGGQTFCSKCTGDNVPVDGECTAKGGAAMCTAGTDDKAGTCTKCAGAHSLYMGGCYEHCPYGPGDAANVCGDAPAGCNIPNCKSCPDGTCTECNDGFVLGDGNKCVASSVNKSGGLSTGAIAGISVAVVIVVGGLVGFLCWWFLCRGKA

SEQ ID NO: 409 - protein, 143 aa, Giardia intestinalis
MLLLALCFALSTLAVQCRGSQHSSCAAGQCKVVRGVEVCTRCRAGHVLVNGVCTGNAAGNEADSDCQVEHCDRCVSGDDTKCEACSAGFDLDDNTKQCVSSSINKSSGGLSTGAIAGIAVAVVIVVGGLIGFLCWWFLCRGKA

SEQ ID NO: 410 - protein, 807 aa, Giardia intestinalis
MELASLPLTLTCLLAVYFSEKASTYHNGFGYSCKDAVLNCLQDKCLINLTMFLCTECASGYVPINGKCFSIADQLTTKTACVKSPMGGWCMECGDEYFLFYGGCYSLDGTWKKTICDRAENGVCKECGKGSIDYPALVFTNPNTTSLERCIHCGDPIGFGGYSGVYNCQHCSQPRLSGKVEADCGACSDSDVCPFDYRCKPASGIAAFGYCDYCPKAYIWSSDACYTIGSLTGDTICLPRNVIDIQGQSLCIQCANSSEVPRNGRCRPSSGFEDVCMKDPKGGKCESCRDSNAIKYFLFYGSCYQFGGSAENLIGSYICQKVQGNICIACNSSTKEVFTKNNGCWRCGDTANGGIAGCQRCEMKGDALQCLECRDLYLSLDKKSCMVSCPDGQVGAFDSSSKSFVCACDDGLYLKDGGCVKCTIENCAECDEAKCSKCRYGYTLSNDQCAETKCKDPNCDACENRDVCTRCSNDHSLDQNGLCVKDCLSSAGYYKATVGDVLRCVACTLGGCAVCESADKCTTCRDGFYPNGSGGCKACNPACATCSGPEAGDCTSCPAKRRLQYSDGIKGSCVSQCVQDGSCAACGLTIDGTSYCSQCVKSTEYPRNGVCASTGSRATGTTCTNVVGGRRVVCGSSSFRLNGGCYTSKLLPGKTVCSGERDGWCENVAAGYGITYNGTLLTCPEHCKVCTDGSCSSCNSGFYLEKGVCNACPEGCATCPHGKACFDCLAGYYFSENTCKACHKAVPKCSLCAVPEGATQPVCLEYGRSLRPTLSAGAISGITIGAVLVIGTVTAVLVWLLVFRKKS

SEQ ID NO: 411 - protein, 943 aa, Giardia intestinalis
MCWSSLFALLVAVMHAHDEACAYCLRDKCLKTRYGSVCTYCETGYVPLEGRCTAMDVSFCLVESESRGSCSQCAYGYKSFLNGCYLVPLFEKLGKELDNSVSVPSALYISTHVVLNGQILFTGCFMDNELPINGVCAEDTANWCTQSGETDFSYGTSCLQCTGTDVFYFKGGCYSTKTEPGSLICKTASGGICTTCNTDSHYVFANPSTGTKTEQCISCGDGYGANGYSGVENCKTCAAPSGNSNMATCSACPDGYKFNVAQTRCFTCTLQGCLNCDSYESCEHCNTDFYIADQSYSKICATTCPTGTFPFVNSTGYKKCFSCSTSDGSDPIAVERIPGCETCTVNSSNLLTCSACLQGYQLTSTGCKQVCADVSGKCGSNACTVVIGSISYCSDCSGANNYAPINGVCEYVTMNDKSGCRKEETITGSCSQCGEGYFLHMQGCYKADQAPGNLVCSSVGTGSRSSGNAGAGLCSVCGPGYRTKRGRCISCNSQHCLEYIPNTCVCTLCEDNVLLIQGECVPFPSSGCKVPYCALCEKKLEVCTRCEGSYYITPLHGCIKDCGDLLGYHNDADLGRCVRCRIKNCYKCYDSVRCLECSTGYGLTDDQQCARCPENCFACAHYNQCTTCKSGYILNDFNVCESENEYKVDCKHADAKYIKYELARHIKGSVRQRLMASMCSECNAGKVPINGKCVSVSAKTLSCVSGTGENTGKCTHCVSGSNSNSAFLYSGGCYDSTTGVGKSLCTSVGDNGLCARCPRGGFMLDTSRNECVPCPMNCMKCNSSGCLRCDPGWLLIESNCVPCKKGCLECSGSADKCTSCITGYYVAGAVTSSSKNEGACRSCDDTREVDGWKGVHGCTLCTPPVFAGEVLCLSKEVIDDSVTRPLSSGAIAGISIVILVVVAAIVGVLVWRFVYKKKSSKHIKMVDMDASINTSQYMSSSHV

SEQ ID NO: 412 - protein, 450 aa, Giardia intestinalis
MFRKFSVAIFILQLAWAIQVADGCRRATSGNVSTHGMYSPTIENNKYCSQCNHGKGNSSLINREYTANNTTHSKGTKGKLTKCNRNLYLKTESGVTSCVAGEDCGSGSFPTVDSAGNKKCIPCNDSANGGIEHCSECSLLAPTSRSATTLIKCSKCSVNMLSPLGDGCLRECPAGTYDSSDVCALCHESCASCNNNAEPTSCTTCYSGFVLSHTNGPIGKCIPECTGEYIENCDDGQCTAIVGTSTYCSKCKTGYVPVDGICVSVTTREVTECIPNNDGTCKSCKGTYFLQSGGCYQSTTYPGMTLCEKAQDGKCITCTNSQKPDAQGSCPLCELGCELCSASKATTCWTCFPGYYQSGTKCFKCTDNSNEGGRTITGVPNCLSCEPPDNGSGPVTCYVTQQSDKNNSRDSLNKNALSSGAITGISVVAILIIGGVVGFLCWWFLCHKKK

SEQ ID NO: 413 - protein, 744 aa, Giardia intestinalis
MFSGFVFVGLIVQLAWTEQVAERAREAQCADNTNNCELCDVLIGDKLYCSKCKASAVGHAPIDGKCADAASKTPCKENAEGKCTECTGQSFMYKGGCYQVSQEPGQTMCKTAADGKCTEAPASKSYFVIPETKRQPTGQTVVWCGDNAGVTSGGQTYKGVIGCTTCDGSKLTADASGEAVCSACGDNKIVKIAKDSATSCVTEDDCTGAEGFFVKGNLGSKTCEACAETCKTCKTEAAKCTSCKNDKPYLKKAQSQDQTGECVTEEVCKREGTHYADDSKEPKTCRTCAEGTFEACEACEKSREGAVTCRRCKSQKKVQPNKKGCIDACPPNVSVDSHGICECVKGYVPDEIGTGCKEESAPPAPPVAQCSTPGCKACDKPKAGEEVCTECEGAKALTPTGQCIDKCGDLGGYYEGTNDKKKKACKKCEVANCLLCNQEGKCATCKAGFYGEACAACNSACKNCSGPTAADCTECSSGRALKYDATGAKGTCEAGCKPNASGCEKCELTVEGTTYCSKCKEAGQFPQNGVCSAAAGRAVTCATQGTGVCDKCTNGFLRMGGGCYETAKFPGKSVCREVVSDGDTCKTEDLGYHIDNNALMVCSAGCKTCTSNTVCTACMDGYAKTGNSCTKCAAGCATCTNTASACDTCSTGYYKSGSICVLCTANNADSTITGVANCASCAPPSNNQGPVLCYLMKGNDDTDENTNKNAFSTGAIAGISVAVIVVVGGLVGFLCWWFLCRRKA

SEQ ID NO: 414 - protein, 580 aa, Giardia intestinalis
MLLIVFYFVLSAFAADCNGGEASVNCEGASCEMIGDTQICTSCETGFVPINGRCQTKDGVTDKCTDAGGTNAADQTCKKCKGQTFMHKGGCYDKEGEVGRTICKTPGNTEGVCDGCQDGYFKNSSPNDTKDSCVACTPNCIKCSTADNNKCSKCVDGYFVGAASGSEGQCIKCDDTAGADSYKGVTGCNKCKTPTVVGEALCDECSNGLYLKIVGGKTFCVSEDACKEGTTHFPAIDSTNSNKKICVTCDTTANGGIEDCEKCSLKAASAKAAPIITCSKCKTKKLSPLNDACLENCPAGTYPENNDSISVCVPCHNSCVSCENSNAETSCTACYPGSVLSRTTATAGRCIPECTGEFMAHCAAGQCDGVVGGSKYCKKCDNGYVPINGICTAVGAAGRDASMCTAGDGVCTACKNDYALLSGGCYNTNKVPGNLVCETADGTGKCTMCAANNKKPSGDSCPTCSDGCAKCNDSSACTECLPGYYKGTSQCFKCTANSDNGIEGVENCISCAVPISNFGPVTCYVKKDGTSGGGGSSGGGSTNKSGLSTGAIAGIAVAAIVVVGGLVGFLCWWFLCRGKA

SEQ ID NO: 415 - protein, 503 aa, Giardia intestinalis
MLLLVLCFALSTLAVQCRGSQHSSCAAGQCKVVRGVEVCTRCRAGHVLVNGVCTGNSAGNEAVSECRVQNCAECKADDPTKCERCEAGFTANVEQTQCNQDQAPECRVQNCAECKADDPTKCERCEAGFTANVEQTQCNQDQAPECRVQNCAECKADDPTKCERCEAGFTANVEQTQCNQDPEQQCNTPNCKACDNPRTDREVCTECSEGNYLTPTKQCTQSCGTLGGYYNGDKVCEPCDPSCAACATKGPTKCTLCPPGKRLQYTDEGAPQGGGSCVDECRPEGGAGGCETCGATIGGTKYCSKCSTSAEVPVNGVCTADNARASACKVKDGKGGCTTCDNGYFLQDGGCYKLGRQPGEQICTTASSTGKCETCANSLRPTDGVCPSCHPTCKTCSAADIANACTTCATGYYMLGLGPATCTSCERDSGNVKGVSGCLSCAPPSGNTGSVLCYLTKDDGTGGSVNKSGLSTGAIAGIAVAAIVVVGGLVGFLCWWFLCRGKA

SEQ ID NO: 416 - protein, 467 aa, Giardia intestinalis
MLVGLLLVCAAIWANCAAGCKTCNPGDQACTECTDSSHNIQVDGKSCDANCPQNSAANDQKVCVCSADYSPVVGENRCERTPSVGCAAGCKTCNPGDQACTECTDSSHNIQVDGKSCDANCPQNSAANDQKVCVCSADYSPVVGENRCERTPSVGCNTPNCKACDNPKTDREVCTECNDNSYLTPTSQCVKDCTTISGYYGDTNEKKCRACNPECAECVGPANNQCSACPAGKSLEYGNSMYPNNGGTCGDACKTTGGSTGCKVCGSTIGETLYCSQCNNNDQAPLNGNCAVNTRAAFCATITSGACTKCNEGYFLKDGGCYQTDRQPGKQVCGTAGQGVCTKCANGLPADNGDCSGKKCHESCSTCNGIDEASCLICATGYYKENGSDSTAGPCKRCSERIPSCKQCTSPSAGSVICLESEAGTGGNVNKSGLSTGAIAGIAVAVIIVVGGLVGFLCWWFLCRGKA

SEQ ID NO: 417 - protein, 416 aa, Giardia intestinalis
MAWSGQRPLIFPKDTAKKDHYLCGDAAPGARRGASGWTGGPVAKAAAEHSGRCTEVVEKSSPVKILSCRCVCKPTFYNSSGTCTKCADSCAACKDGTSTGCQRCSPGKILSFPIASSESADCVSQCVAGSECAGCGLTIDGSRYCTRCKDSSMYPFNGVCILDAKKDAYCTAKANGVCTACSEAAFLMSGGATQQHTIQATPSAMQRRVASARHPGRGTGYQPMESCSPRPGVRLPAHGCAERGLAGHDGLPIARCPRNRDVLAAITRGGAGSAWCLLAHSTARRASSTVAPAHVQEAPGSALGADPASTGVAALVPAERAAARPCPARLRQPVARVAQLAPHTALRRGGVAILPGARRRPDGYPRFGAHPAAGSSRVTGASCWFAQGRPSSSSAQASPRGRPTDGLPRRCLAPRA

SEQ ID NO: 418 - protein, 675 aa, Giardia intestinalis
MLLIVFYFVLSVLTAECTQRDNQEKCATGKCDMVSTTEVCTKCKTPGNVPIDGVCVEASTASGKCEKAVGGAVNREDTVCGKCLDNYFMYRGGCYLAGAAGPGIGTKMCETAESGKCTAAAKIKNFFVPPTDTDATHDSVVWCGDAAGLQLGGKTYTGVADCATCDAPTSADPSGTKAATCHACRGEKLVKTVGDVTSCVTEEDCAGAEGFFVNNRDGKKCSACADTCKTCKTAADQCTSCKPDKPYLKKDDGSETGTCVDKATCPTTSTHYIDEESKTCTTCTSGGAKDCKTCEKSSGGAVCKECPDSDKTIFGLNKKSCVAQCPVNSTPKATKQSIQVCMCEEGFQPNAESTECQPTSKCVTPGCKTCDNEGTDKEVCTACLEGKYLTPTNQCIDHCITIAGYYDGTDDNGKKTCKKCNSACAECVGAASNQCSACPARRMLQYTDASTPAHGGTCVDQCSVSTTTEGCAECGARIGGTDYCSKCKGSQVPINGVCAANPSARAAACTSDGQGACTSCTGDYFLRDGGCYKTDRLPGKSICTQAANGQCNKCANDLVVSGGNCGECHPTCATCSAAGAADKCKTCVTGYYKTSDSEGSCKKCSEGLAGCRQCTASIGGKFICLEMGDGTTDDGSTNRSGLTTGAIAGIAVAVVIVVGGLVGFLCWWFLCRGKA

SEQ ID NO: 419 - protein, 745 aa, Giardia intestinalis
MFSGFVFVGLIVQLAWTEQVTCTVETETGQCKENMCIAIGADNVCTDCGKAGEVPINGKCVAFNTANDKCKKADNQQLDGTDTTCGKCEGTTFMYKGGCYETTGTPGQTMCKTAADGKCTEAPDSKSYFVIPEANRQPTGQTVVWCGDNAGVTSGGQTYKGVIGCTKCDGSKLTADASGEAVCSACGDNKIVKIAKNLATSCVTEGECTGAEGFFVKGEQDPKTCEACAETCKTCKEADNKCTSCNEGTPYLKKDVGDTGTCVDANGCTSVKTHYIDDTDDPVSGKTCKTCVSGGAVDCETCVKEGDGAICKTCPSAGNTLFGLNKKSCVAQCPDHSEADDDKICKCDSGYMLNETGDGCKEGSAPAPVECPIEGCKTCSTDKKACEECEASKYLTPTKVCVSDCAAIPGYYNGANDGKSACKKCVVENCVVCTGDGTCEMCTDGFFGPSCSQCHETCKTCNGGSESDKCTSCKAGSALAYGSTGSTGTCGAECTTGMGAGKCKECGLTVEGTRYCSRCSEDKEYPQNGVCAKASARTSSCQDTNIAGGVCSTCENGFFRMNGGCYKIDQYPGKAVCAQIESPVGTCEKAADGYKLDAGVLIICPEGCKECANGSACDVCKDGYVKLSGAQTCTKCDTSCKTCKTATTKCVDCSAGYYKTVLEEGACTSCEHSNNGVTGVANCASCAPPSNNQGSVLCYLMKDGGSTNKGGLSTGAIAGIVVAVVIVVGGLVGFLCWWFMCRGKA

SEQ ID NO: 420 - protein, 805 aa, Giardia intestinalis
MMQILLPLTVACLLVGVFSEEASIYRNGFGYSCKDKAPKCLPNKCVVDVTSQSLCTECESGYVPINGKCVPAADETVSKAGCAGSSQGGWCTKCGDDHFLFYGGCYNSSLEWTKIICERAEKGLCTKCANKGYRLTLVFTNPNTKAPERCILCGDTVGFGGYSGVYGCLFCSPPRTKQGIVATCYGCSDYEDACVYDYRCKRITEGTYTGRCIYCPNTHLWSFFACYARDTPVGASICLPKDTMEVSGQVLCSRCANPSEVPVNGLCTPVVELKGLCVKDPKEGKCTSCRDRTGGQTFLFYGGCYSLHGNSHQVGPQLCQKAQDNVCIACNSSIKEVFTKDSRCWRCGDTANGGIAGCQRCEMKGDALQCLECRDLYLSLDKKSCLAGCPRGQRGVRDPSSSVHSCTCDDGFYLKDGGCVKCAAENCAECDEARCSKCRYGYTLSDSRCAETKCKDPNCDTCESRDVCTRCAGDHSLDQNGLCVKDCLGSASYYKAIVGDVSRCVACTLDGCAVCESADRCKTCRDGFYLESQERCKPCSSACATCSGPEAGDCTSCPAKRRLQYSDDSKGSCVPQCVKDGSCAECGLTIDGTSYCSQCVKSTEYPRNGVCAPTSSRATGITCTNAFGGQCIVCGSSSFRLNGGCYTSKLLPGKTVCSGERDGWCENVTAGYGMTYNGMLLTCPKNCAVCSGGICSVCNNGFYPEKGMCNACPEGCATCPHGKACFDCLAGYYFSGSMCKACHKAVPKCSLCTVPEGATQPVCLEYGHVSRLSAGAISGITISVVLVVGAVTAILVWLLVFRKKN

SEQ ID NO: 421 - protein, 426 aa, Giardia intestinalis
MGEGIVTDNSMFAKLIFTSLILQLAAALRPIERRSGNACTGLGSAGCQTCSGSGSNEICLTCKDKVQFITVNKKAARPPATQQERFQIQITRRPACVIRPVDTHSRVTGRAPRGSLATRATPPTVKRVTILKLTGKSALSVTMTTTSPQQTSVYLTAQPSRDTNEKKCKACNPECAECVGPANSQCSACPAGKALTYGDSTYPNLGGTCGDACTVDKNGCKVCGARIGGTDYCSQCSGTQVPISGVCVENASGRAALCTAKGDGTCASCAAGDLLKDGGCYKTDRLPGRSICTTASNNKCTKCANGLNADGNGVCGECHSTCATCSAAGAADKCRTCATGYYKENADNSADGTCKRCSEKIPGCKQCTSSSADSIICLESEAGTGGSVNKSGLSTGAIAGIAVAVVIVVGGLVGFLCWWFLCRGKA

SEQ ID NO: 422 - protein, 677 aa, Giardia intestinalis
MLLIALLFVSSTLAEACQPDGDHAATCTSAKCEVVGSSEICTQCKTGGVPIDGFCRPVGSPQVITAGCTRGDGTALEQTASTCEKCGSGYFLFMGGCYRTESQAGSEICTAARDGKCTTCKTGGGVFQSPANPMTPGNECVLCSDVTPRDGVMGVASCYTCTAPGGGSGAATCTTCQSGYYKESTECKKCVAGCIDCNAASQCTTCEDGKYLKDGNSCVDPSGCTGANYPDPESRTCKASGIGSCTNCVYNATVNKPQCTACDGGKKVKTAVDGTTTCIDLSSGCEDSNHFKADGDAGCVLCSDTSGDNPAENKGLEGCSACTKQPSNPPICTGCLPGYYDSAPSTFKCKPCDGNCATCGSAGKDKCDTCKPGFFLKVSGTPGECFPCDDTANGGSEGCGVCSSNNGFECTGCKPNYKQTGARSGSVTCTKVCEDETACGGTAGACDATVVDENGTTKHYCSFCGESGKFPIDGKCTNVNAGNDGCANGVCKSCTTGYFLYMGGCYKYDAALGNHMCSTSTAPGVCSTPNPNKQFFVVPEAAATQQSVLACGNPLGTAVGDKTYVGVEGCSQCTAPAQLDAPGMAAATCTACGEGRKPNKSGIGCVACSVENCKHCRVDGVCEECSSGFSLEGAKCVSTGGPNLSTGAIAGISVAAIVVVGGLVGFLCWWFICRGKA

SEQ ID NO: 423 - protein, 480 aa, Giardia intestinalis
MLLKITLTFAAVLASCQEGAESTNCKTGRCTDIEGTPYCSECAVPTEAPVNGECKEVSADPFCTGNGAGACSACKGASFMYKGGCYEQAKPPGSDLCKSTNNAGVCTAPNVSGKYFVPPDTDASHQSIVGCGDTSGMRYQPSDGIDKAYKGEANCETCTAPQQVADNTGTATATCTKCAGSNIVKTDTDGTTCIPESECPTANGFFVEDPGSGNQKKCNPCSPNCLSCTSAAEATCASCTAETHFLAAETGQPGKCVSCGDAVTGSGDWKGVSGCAKCTKPEVAGAATCTECTSDYLKTDAGTTSCVQKGQCNGGYFPNDNVDGKKQCIPCGTADHGGVAGCTACSPLQPASMVTAVLVKCSACAPNSKPNVAGTGCFTCSIDGCDNCSENGVCEKCGNAKKVSPGKNSCVEQCPENSIEKESVCVCNSGYDPDSAGTGCVTVSINLSTGAIAGISVAAIVVVGGLVGFLCWWFICRGKA

SEQ ID NO: 424 - protein, 658 aa, Giardia intestinalis
MLLVAFYFVLNTVAEVCTGDQLAACGDSQCETLNSVQICFQCRTEGNVPIDGVCTPKNEVGDKCKKAGGGALDETAKVCGECSGNYFLHKGGCYSVTTDKPGHALCTATENGVCTQGADGYFAVPGAPKTGESVVACNNNAGTSINGNMYKGVQNCATCQPPAGPAAVREDTIAVCKSCLEGFFHTDERTCTACGGTNCAICTIGATEKMCTKCKITNDEQYLKKDIDSETGECVSAATCIGNAKYYVDDTVDPTNGKTCKTCASAGTIDCTTCEKGVDGIVVCKTCETEQKTKFGLGKKSCVEACPENSTESDEEGKKVCKCNTDFKPSEDFTKCIVDSACKTPYCKTCSNDVCTMCASGYYLTPTSQCISDCTTIKGYYGDSRDKKCKGCNSECTECVGAANTQCSACRAGKMLQYTKPNTPIEGGTCVDQCTVSSEAAGCETCGAKIGGTDYCSKCKEEQVPINGVCAENSAASRANICTSNNNGGCTGCADGYFLFANGCYKIGQQPGKQICAQANGSGECQKCANGLQAQGGDCSAYMCHPTCATCSAANQENKCTTCATGYYKTTQEGACTSCESDSNGVTGVRNCLNCAPPSTGSGSVLCYLMKGGDSTGGSTNRSGLSTGAIAGIAVAAIVVVGGLVGFLCWWFLCRGKA

SEQ ID NO: 425 - protein, 922 aa, Giardia intestinalis
MYCGACSIEGDVPINGVCVAAGAESSGNTCDKGVCTACTAGYFFHYGSCYKFGESPGSIVCPNQSDTTGSVCGSCGPKFVKNPNASSSATSCLACYGLDGTLFCDECRISVLTGEGAKPTLCTRCKSGHVPIDGRCVSAYSATAALAGCSDVSTRGLCETRSSGYMLFYGSCYLIDGLCIADKGSHTCADGVCTAYDTTTTSIDNSKVFLFYNGCYTQDRSSIGGYICSHASGGMCTECNVGAQGSYVFTNPDISAAERCILCSDTTGFGGYRGVSECHSCAQPVGSGVATALCTKCRSPEQGDDLAPIDHQCQAKGPHDCRAGVCLSCYKTHLLHQSGCYSRHSTTGTAVCAAANQYVLDNVTICGECADASYAPINGACTRVQGGTADAEPHDCTQGRDKGLCTDCAGSAESFLFYGGCYGKGSGTGAKLCSAVASGVCTEWRTQFDFIFSKDGKSGGYLCGDAENGGISGCATCSYGDGALTCTRCSSGYLGVDGRSCSEGCGDGAQGVCAGTAGGSEPAGGACRCVCKPGLYNSSGACTSCADSCAVCKEGVPDGCQRCKPGKVLEPSVVARETARCVDECTAGGECAECAIAIDGSRYCTRCRDPSMYPLNGVCLAGAREDPYCTSRGDGVCTACAEGAFLMSGGCYRTGVYPGSVICSVQSGGRCKETKKGYGMSDDGELLQCDPTCLECKAPGPGRCTRCPPGRLLRRAPAAATGSCIEPGACADGYYADGDACLPCVVPGCRACGHTSFCTECAGELFVGLDGRACLRECSGDRVVGEASGGTRRCWCERGFVPAPDRSGCVPVTGCSPDMPWCASCDESGRCLSCAAPGHNIQVDQRTCAEGCGDRAAPDQGVCVCETGTVLDKDACVPINALTGRKMMVVTTSAAAAVLVISVLVGFLCWWFICRGKRRCYR

SEQ ID NO: 426 - protein, 683 aa, Giardia intestinalis
MLLVVFYFVLNAFAAPCDPDGNHLTTCAHEKCEKVNAFEVCTECKAGGVPIDGFCRPIGSPQVITAGCTKGDGTALEGTATTCGKCGSGYFLFTGSCYKTGSSPSDEICTTAEGGTCTVCNTANGLFKNPAAAPDAGRECLFCWDTAEINGITGVVGCSECSHIGTSGPVTCSACQDGYFLDKAKNTCTQCTSPCRTCTATGSAACTSCIVGNYLKGNQCVEEAHCTNAEYPDKKSGECKACNIIAGCTTCAYDDKLNGPKCSNCGSKIIKTEVDGTTTCVEAAGCAANGVAGSHFLTADNQKCFLCSDATTDASTLGNKGIANCKTCTKTESGSNPTCSACLDGYFFEGDSCTKKCADNCATCSAETAEDKCLTCKAGFFLVEATKPAGRCIPCDSTQNGGISGCAECTGTAGSLKCTQCKPDYAPIELGCQRSCEDVTGCGGTAGACDATVVDGSGITKHYCSFCGESSKFPIDGVCVSDTKSNTCGNHICTACTTGYFLYMGGCYDVSKAPGNYMCKIVGKEGICTEAASDKYFVVPGATSTEQSVLACANPLGTLAGGNAYVGVDGCSTCTAPAGRNDGGMAVATCTACGEGKKPNKSGNGCVLCSVKDCKSCKADEKCEECSSGFSLENDKCVSTGASGGNRSGLSTGAIAGIAVAAVIIVGGLVGFLCWWFICRGKA

SEQ ID NO: 427 - protein, 722 aa, Giardia intestinalis
MFGRLLFAGAVLQLARAVCEADGSGGAGSCKTCGVTIGGSEYCGECNDGTNYAPVDGVCADAGQAPASTFCPQHDAGKCTQCESTSFKYKDGCYQPNDGKPGQTLCLVASGGVCTEAAPGYFVPTGAVNTEQSVVACSDTTGVAIAAGGSTQKGVADCAECSAPDAAPGARADKVATCTKCGASKYLKDNGCIDKAQCDPDSTNRFVAVDDPENGNRCVSCSDNPNGGVTGCDTCSYDEQPKRIRCTKCSGNKYLKTTTDGITTCVEQNACTPDSFPVEDTQNGNKCVSCSDANNGGIDKCTACAPIGTGRAAIAVTCTACAAGYKPSADKTTCEAVTNCKTPGCQTCNNEGKENEVCAECASGAYLTPTSQCIDSCDKLGNYYGATEGAKQTCKECAVPNCKTCNNQGQCQICKDGSYKNGDTCSLCHESCKTCTAGTANDCTECPTGRALKYGGDGAKGTCGDGCTTGQGSGACKTCGLTIDGASYCSECAVDTEYPQNGVCASATARAAATCKTGNVAKGACNSCTNGFLRMNGGCYETTKFPGKSVCTTTPGTDTCTSMASGYYIDGSNNLVVCSDGCADCTTPSTCTTCKDGYTKIGSGQTCTKCDPSCETCSGAATTCKACATGYYKTASGEGVCTSCESDSNGVTGVKGCMNCAPPSSSTGPVLCYLMKDDSTGGSTNRGGLSTGAIAGISVAAVVVVGGLVGFLCWWFLCRGKA

SEQ ID NO: 428 - protein, 818 aa, Giardia intestinalis
MMQTLLPLTVACLLVGVFSEEASIYRNGFGYSCNDKVPKCLPNKCITDIILQFLCTECESEYVPINGRCVLTTNETVSKAGCAGSSQGGWCTKCGDDHFLFYGGCYDSSLEWTKIICERAEKGLCTKCANNGYRLTLVFTNPNTTAPERCIYCGDPIGFGGYSGVYNCQNCRQPRLPGTTEADCYGCLQQEMCSFDYRCKPAGDIASFGYCTICPKTHVWSDFACYAIGGATGDSVCLLENIIEIQNRSLCTRCTNPLEAPQNGRCLSISKFDNVCVKDPEKGQCTSCQDRDAEKYFLFYGGCLRKDTSYQIGSQICQEVRDNVCTMCNSSTEEVFTGNNRCWRCGDSANGGIDGCQRCKVGSDGLQCLECRDLYLSLDKKSCLAGCPRGQRGVRDPSSSVHSCTCDDGLYLKDGGCVRCTVENCAECDEAKCSKCRYGYTLSDNRCAETKCKDPNCDTCESRDVCTRCAGDHSLDQNGLCVKDCLSSAGYYKATVGDVSRCVACTLGGCAVCESADKCTTCRDGFYLEGQERCKPCSSECATCSGPEAGDCTSCPAGKRLQYSDGTKGSCVSQCVQDGSCAECGLTIDGTSYCSQCVKSTEYPRNGVCAPTSSRATGITCTNAFGGQCITCGPSSFRLSGGCYTSRLLPGKAVCTTESDGWCDTTVAGYEITHNGALRACPKNCAVCGGGVCSACNSGFYPERGACRACSKGCATCPHGRACFDCLAGYYFSGSTCKACHKAVPRCSLCAVPEGATQPVCLEYGHVSRLSAGAISGITIGAVLVIGAVTAVLVWLLVFRKRAGVPPLYKQSTVASTQ

SEQ ID NO: 429 - protein, 862 aa, Giardia intestinalis
MFGRLLFAGAVLQLARTATCTGSNSAQSTKCVQEKCNVWIGGKDYCSQCSTDAELLIDGGCVPTTSDLAKKCITDNKGKCSSCGDGYFLHRGGCYQFGGEVGKLICSDPAPSLPGTTLPAGACTTCGSGYFKNPAESAANTPPCIACNDTAGDSGNTGLVGCSTCDPPISGQATCTACLEGFYGTTSCQQCDESCAACIEQGISKCTKCKSASGKEYLKITDSQTASGECVPQGSCIGTHFPVIAEKKCYFCNTIEKGGKPGCKTCNGDSSSITCSACLDGFFGSEECTPCDISCLTCEAAGKENCKSCSAETHFLASTDTKGACVSCSTVQAAWSGVANCAKCDRPASSDVSAVCKECNENFYLYTPPALGKNKLPPSCVITCPAGYFGHTATSSGIRTCQPCATANGLSPDVTGIAGCKKCTYTDSLQCDECEQGKKPSLDKTKCNICIAANCATCDSEGTCQGCNSGFLLNNGNCVESTCKTENCEMCDDAKTENEVCTVCVSKYYLTPTNQCIDDCTKIGNYYGVTEKTRGICNICTVANCKECENTGTCRACNDGFYKYGEECKPCDSSCKACSGEGGTKCTECPVGKVLEYIGTEGQCIEQCVVNDDQASGSCKKCELDIGGTKYCSQCSRQNEYPQNGICTPSTQRASSCQTGPQNGMCATCADTFLKMNGGCYETTKFPGRSVCTNAPTGGTCTSPLPGYYFNGGALTVCVEGCKTCTNNVACDTCKDGYVKLGGVQACTKCDPSCETCSGAATTCKACATGYYKTASGEGVCTSCESDSNGVTGVKGCMNCAPPSSSTGPVLCYLMKDDSTGGSTNRGGLSTGAIAGIAVAVVVVVGGLVGFLCWWFLCRGKA

SEQ ID NO: 430 - protein, 987 aa, Giardia intestinalis
MLITFLIVLNTFAADCQQDRDHAAICKSGSCELIDGMEVCTQCKAGGVPIDGFCRPVGSPRVITAGCTGSEGAPLDKAATTCGRCSGANHFLFMGGCYNQKMGIGGTICTAASGGECTACAKAGWLFENPSGTPAPGTKCILCSDVNGDGKAKGVENCAECTKPADSPGVATCDICRIGYVNKSNVCVQCGDGCYECLDNNQQTCTACFDGKYLSTDKCVDANRCGDGNYADPKTNECKACITAECATCIYNTIIDREQCIVCNNDPTKMVKIEANGETTCVDKATCATDNTPGSHFLSTNSQKCILCSDNSDADNQGIDGCSTCKKKTPTDAFVCTECLAGYIKKGSDSVTCEPCGANCATCTQIGDDQCTACKPGYFLKSGRSPSECIPCDGEGGTEGCGICSNDSNTFKCTDCKPNYHKRAGGGSAVTCEKFCEDSTACGGTAGTCGAIVVQNTGDFLHYCSLCGDPNTFPIDGKCVDNAQGNTCANGVCTQCAAGYFLYMGGCYSVTSAPGNLMCKTAEGGKCTAPNENNKYFLVPGAASNQQSVMACENPLGTAVGEKAYVGVEGCDTCTAPAPLTEAGMRPARCTTCNLEVDKPNLAGSGCFRCTVDGCSHCSANEVCEACTNKEQRPNTAGTQCISCNINGCTRCSEENKCDQCGDGYRLEGETCVQIQPNPCKTENCQECTNRGKENEVCTKCISTHYLTPTSQCVKDCTIISGYYGDADKKCKRCHDACAECVGPANNQCSACPAGRSLAYSNSIYPDNGGTCGDACVVDKNGCKVCGAKIGGTDYCSQCSDATQAPLNGNCAANTRAAFCTKMSTGACTQCENNYFLKDGGCYQTDRQPGKQVCSGAQGGNGKCQTCANGLAASDGNCGACHSTCATCSAAGAADKCKTCATGYYKTSDNEGSCRKCSEGLVGCRQCTASATAFVCLEMSDNTSGNVNKSGLSTGAIAGITAVAVIVVGGLVSFLCWWFIYRGKART

SEQ ID NO: 431 - protein, 491 aa, Giardia intestinalis
MLVGLLLICTTVLAKYNGRDVCEKSSNTECAQGLKDAGCLTCTEAGHDQTCLTCSGGQKVLLDGTSCGADCPENSAANPSVCVCNPGYNLNSGKTACEKSSNTECAQGLKDAGCLTCTEAGHDQTCLTCSGGQKVLLDGTSCGADCPENSAANPSVCVCNPGYNLNSGKTACEKSSNTECSTPNCKACDNPKTDREVCTECNDNSYLTPTSQCVPDCTAIKGYYGDTDKKCKKCHDTCTECVGPANSQCSACPASKALTYSDSAYPDRGGTCGDACKTTEGSTGCKVCGSTIGETLYCSQCNNNDQAPLNGNCAANSRTAFCTTVSDGACTQCAAGYFLKDGGCYETNKQPGKQVCSSAQGGACQTCANGLQAQNGDCSKSACHPTCATCSAPSTASSCKTCAAGYYKENGNDSTAGPCKRCSEKIPGCKQCTSSSTGSVVCLESEAGTGGSTNKNALTTGAIAGIAVAVVIVVGGLVGFLCWWFLCRGKA

SEQ ID NO: 432 - protein, 623 aa, Giardia intestinalis
MFDTFLFTAIILQLAWTEREREVVKAVQCPEAGDSPATTQCKQGKCIAIGADNVCTDCAFTDEVPVNGECRAADTTTCKTGGQSGVCTECATTANIFMYKGGCYTTSEAPGQTICTAADSGKCTSAGTGYFIIPAEDTDASHQSVVSCGDAEGAAVNNDKTYKGVKDCAECTISGSSAVATCSKCATGVLYTSSEKETSCPAACPEGYFVHIAKSTNIKTCQLCSDPTGGLDPAVVGVAGCVKCTYDNSKVTCEECDQGKYLKVEGGATSCVDAQDCGKGFFMTTHGGVKKCVKCSDANNGGIENCEECALKGGAARAGAEITCTKCSSNKLSPLGDACLADCPAGTYDDSSICKPCHESCASCNANAEATACTACYPGYVLNRDETNTKGTCIKECTGDLVAYCKSGGCTLDVGGSKYCDQCEDGYAPVDGICTKVSSTAKDASGCKASGGKCTACSGNYALISGGCYDTQKLPGMSICTSANTGHCTMCVTSDADPQGKPCPTCPAGCAKCAGDAGSQTCSECFSGYYLSTDKCFRCNVGNGGNIQGVPNCISCKAPSSPSAPTPVTCYVTQQRTDDGTGGSTNKSGLSTGAIAGIAVAVVVVVGGLVGFLCWWFICRGRA

SEQ ID NO: 433 - protein, 778 aa, Giardia intestinalis
MLFAVLYLALGTLAAPCQPDGDHVATCQTGKCETVGGAEICTECKAGGVPIDGFCWPASSPSAALAGCVPGASSGVCTRCSSEGHFLFMGGCFKKGNASSQTLGDSICETAQDGRCTKCKTDGNVFQNKADSPALGSECILCSDTTGANGNTGADKCLKCTSPAGSTGAATCKMCEEGYFLNTDGACEKCNSSCLTCSGGGDTKCISCKANTYLLANKCVQNNNCGSGKYADPRSNECVDCGIDGCEACEYSAVIEGPKCTACNGSNNLVREEADETTTCVDDTGCVKGSTHIVDNTNTKKCLRCGNNAEGGILGCDTCSSKAACTKCQDGYVKKALDNTCEACGNNCATCTTKGQCDSCLLGFFHDTGAHSCTACASNCETCTEANNPNRCTTCMPGFFPIDAADSQGKKCVACDSIENKGLEGCSACSNSGGFKCTDCKVNYKRQSKGEAPDDFICIKVCEDEAACGGTAGACDAVVIDDAGKELHYCSFCGDTSQAPINGKCVAAGSYDSNTCSKGVCTQCTANYFLYMNGCYKIGQTPGQYMCTAAATGFCTAPDSKKKFFNIPEATKQEQSVLACGNPLGTVTGADGTAKAYVGVPSCTACTPPSAPSNGGMAAAKCTACEAPKKPNQDGSGCTLCAVAECKSCITDDVCEVCENSKKPNKAGNACYACSPEGCSHCSADNRCEACADGGKRPSLDGAQCITCDIDRCTRCSAEGVCGECEAGYAPKDGKCEPGSTGPNLSTGAIAGISVAVVVVVGGLVGFLCWWFICRGKA

SEQ ID NO: 434 - protein, 785 aa, Giardia intestinalis
MHRQHSWAWCEAELMAGWEARPPDGPQSQRPKDASSQALAEWVTHGEQRRGRRADHRHSDRPGCSGGRGPSGILHQELPHPVDTTMLLIALLFVSSTLAADCRPDGDHAATCQTGKCEVVGSSEICTQCRAGGAPIDGFCRPVGSPQVITAGCTKGDGTALEQTAATCGKCGSEYFLFMGGCYNQKVGIGGTICTAAAGGECSTCATANWLFENPSRTPGPGTKCILCSDINGDGTTKGVENCAECTKPGTPIATTCSKCKAGYAKKENACVQCGDGCSECSAATPTQCTACFYGKYLKADKCVDASGCGDGNYADPKTNECKPCGIAECATCEYNATIGKPQCKTCNPPTKMVKTAADGVTTCVDESGCTSGNTHFVTDSGSKACVPCSDIKSGGVAGCSTCTAKGQCSTCLSGYFGSSSCEKCGANCATCTQAGDTNCQTCKPGYFFKSGSGPGQCFPCDSKADKGIEGCSQCSNGPTPTCTECKPNYHKKTGSAVTCEKFCEDSTACGGTAGACEAIVVKNAGDFLHYCSLCGDPKTFPINGKCVDNAQGNTCANGVCTQCAAGYFLYMGGCYSAANTPGNLMCKTAEGGKCTAPNENNKYFLVPEAASNQQSVMACENPLGTAVGEKAYVGVEGCDTCTAPAPLTEAGMRPARCTACNSDGKPNLAGSGCFKCNIPTCSHCSANGVCEACTNKEQRPNTAGTQCISCNIDGCTRCSEENKCDQCGDGYRLEGEACIATKPSGGNRSGLSTGAIAGIAVAVVVVVGGLVGFLCWWFLCRGKA

SEQ ID NO: 435 - protein, 683 aa, Giardia intestinalis
MLLVALYFVISTLAVDCQPDGDHATTCQVGKCELVDDTEICTECKAGGVPIDGFCRPVGSPQVITAGCTGPEDAPLDKATTTCGRCSGADHFLFMGGCYNQKVGVGSVICTAAAGGECTACATANWLFENPSGTPGPGTKCILCSDIKGDGTTKGVENCAECTKPAGSPGVAICSKCEVGYYKDGTCKKCDATCLTCSGSGNTACETCPEGKYLKVNQFVQSTGCDGNTYPDPETRTCKASGIADCTTCEYNPVTKGPRCIACSGKIVKEEADGTTKCIDAGTCTQNGATGENFLSDGDTECILCSNDSSKTDNNKGSVGCRTCNKNGAKPECKTCLDGYYDSGNGNPAVCVACAGDCGKCGPGGAIDTCEKCKSGFFLKSEGTKKCVRCDDPADGITGCATCTFSGLLTCDTCKPNYTSKTTSRGVACEKACEDETACGGTAGACDAGIVDPSGKTLNYCSLCGDPATFPIDGKCVESSKKGANTCDQGACTQCTQGYFLYMGGCYRYDAAPGSHACSASAAPGVCSAPSPNNQFFVVPGAANNQQSVLACGNPLGTAVGDRTYVGVEGCSQCTAPAQLEASGMASATCTACGEGRKPNKSGTGCVACSVENCRHCRVDGVCEECSSGFSLEGGKCISTGTSGGNRSGLSTGAIAGIAVAVVVVVGGLVGFLCWWFICRGKA

SEQ ID NO: 436 - protein, 680 aa, Giardia intestinalis
MLLIALLFVSSTLAADCQPDGDHAATCQTGKCEAVGSSEICTQCRAGGAPIDGFCRPVGSPQVIAAGCAKGDGTALEGMAATCGKCGSECFLFMGGCYRTGSQPSSEICTAAEGGKCTECNADNGLFKNPAAAPDAGRECLLCWDTTGANGYTGVDKCTACTKADKTEGKAECSACQDGHFLSDKLCKPCTSPCATCEAAATTCGSCIAGQYLNGNTCVAEGSCGGSKYADELTMTCKACTTIHEQCTACSFDKARGKPKCTNCGPSNTPRTSLDGTSTCVGKTDQGCQGEDKELFMKEVDKTCALCGDDSTKTPGNEGKANCKKCTKTTTANPECSECLDGFLFNTDAKTCADKCDDSCKTCSVKTNPNKCESCYPGYFPIDSTEPPGKKCVPCDDANSGGREGCSACSNTGGFKCTDCKANYQKEGSPDNYTCKKTCEDETACGGTAGACDAAVVDGSGITKHYCSFCGESSKFPIDGVCVSDAKSNTCSNHVCTACTTGYFLYMGGCYKAAGPPGSLVCKAAGDGVCTEAAAGYFVPPSPTKDKQSALSCSNPLGVELADQKAYAGVEGCSRCTAPAQLEASGMAAATCTACGEGRKPNKSGTGCAACSDANCRHCRVDGVCEECSSGFSLEGGKCVSTGGPNLSTGAIAGISVAAIVVVGGLVGFLCWWFICRGKA

SEQ ID NO: 437 - protein, 597 aa, Giardia intestinalis
MYLGGCYLVSDGLPGNSLCVLAANGICTEAAPGYFLNPLKANSKDSVISCSNTTGFTESDKTYRGVQHCDKCDGSALTGNASGDAKCTKCSSNKYLKSDGTGCVDAANQCNANTEFGKENQETGNKCLKCNDPTSGVADCAECTGIAEGKTKPACTKCSAGFLLAPEGGETSCPANCPEGYFGHTDSTQKKTCQSCSSENTGLNPAGAGVAGCVKCTYGSNKVTCEKCGQDKYLKIDGETTSCVDAQNCGEGFLMITSGDIKKCVKCGDTANGGIEHCAKCSLKASSAEEKLEIMCSECTDRRLSPLNNACLENCPAGSYAHDGNLCLPCHNTCAECDGNAEATSCRACYPGFVLSKGNSGAIGTCIPACTGKYAENCEENMCTALVGGSKYCSKCKTGFVPVDGICVSSTARAPTGCTPGDGVCTACTDSYFLQSGGCYQSTAFPGNKLCTTASQGKCTSCANGQQADGSSGSCPACDSTCETCTEANKPDKCSTCPPSRYLDSTANACKLCTESSNNIQGVANCLTCVPPSGNSGPVTCYVKADGTSGGDDGTGGSTNKSGLSAGAIAGIAVAVVIVVGGLVGFLCWWFICRGKA

SEQ ID NO: 438 - protein, 460 aa, Giardia intestinalis
MFDKLIFASLALQLAWASQTASTAIVGSTPCNPQTPGQTSCAADSCNVEIDGQTFCSKCTGGKVPVNGECKTKAEASLCTPGTDAQEGTCTACTGAQNLYMGGCYNDCPHGASGTANVCADAPSGPTPCNPQTPGQTSCAADSCNVEIDGQTFCSKCTGGKVPVNGECKTKAEASLCTPGTDAQEGTCTACTGAQNLYMGGCYNDCPHGASGTANVCADAPTGCNIPNCEACSEDKRTCTRCQTRYFLTPEKNACLDACPAGSYATGQACTPCDPSCAECSGAGASKCTACPAGKMLRYADEGKPTDGTCVEGCVEGPECEACGLTIGGTKYCSKCKGSSVPLNGVCTSNAARAQFCTTAADGACTVCAAGYFIQGGGCYETTRQPGEQICALTDNKGKCQTCANGLGPDGAGTCPSCNPTCKTCSAANQENKCTTCATGYYKTALEGVCTSCESDSNGV

SEQ ID NO: 439 - protein, 829 aa, Giardia intestinalis
MLGFLWALLLASLCKDSRDTYYNSFGVKCENKQENCAQNRCLSIGSWTPCTQCVPGYVPINGTCQKYPGDSSSSCTPDDPNSPTRCIRCTSTANVFLFYGGCYTITTTKDKNLGDFLCSEALSGVCTKCFESKLERYVFTNPEQTAAEKCILCSDTVGFNGYKGVSGCLDCLLPITDKIGTALCVKCDYTEQDRDFYPIDYKCQPNGLHICANGYCTSCYKTHLSYKYGCYSRHSSTGLAICAEANQYELDNVTICKECVNASYAPKNGACTLVKNDDSLDNSFSDCTKDENRGLCTGCSNTGESFLFYGGCYDRSSRIGSRLCSKVEQGKCTQWSSTFDFIFPKTDTSSGDRYLCGDTSKDGVAGCATCSYANGAVTCTRCSAGYLGVDGRSCGKDCSENTQGACSEVVEKSSSVKILSCRCVCKPTFYNNSGTCASCADSCAVCKDGTSTGCQQCSPGKILNFPIASSESADCVSQCVVGSECAECGLTIDGSRYCTRCKDSSTYPFNGVCIAEPAQRDAYCTTKANGVCTTCSSSVFLMSGGCYTTNTYPGNTICDKQADGKCTTTKEGYGISDDGKLQPCDPTCLECAAPGPGRCTKCPPGKLLRRAPAAATGSCVEPGACADGYYADGDACLPCVVPGCRACGRTSFCTECAGELFVGLDGRACLRECSGDRVVGEASGGTRRCWCERGFAPALDRSGCVPAAECPPGMPWCASCDESGRCLSCAAPGHNIQVDQRTCAEGCGDRAAPNQGVCVCEIGTVLTRGVCVSTRDAAKKKTAAIAAGTTAGILVVGALVGFLCWWFIFRGRRIGSSSSVTSLIHSKSA

SEQ ID NO: 440 - protein, 765 aa, Giardia intestinalis
MLSAPWAVSSMFEKILFTSLILQAAWSACTDDTVAPGKCAKGKCDVTIGKTKYCSQCSTEGEAPVGGECVSVTEPGPAKQLCPQSVGGKCTQCAQDSFMFSGGCYQVKQEPASSLCTSTDRAGVCVIAASGYFVPPNANSRQPSVVSCSDTAGVILGGKTYKGVAECTRCTTEGLTSEGGAARCVACEGKKPNKAGTGCFTCSTPNCATCSADDTCETCTDGTTSSGSCAEAKAGCHATCINTKCESGHTIDKNKCKECKADAPYLKLASSAATYGECVTAAECTADGTHFTKDNVQINSSPIKVCLPCSDTKGITECQICMSEPDAAALSCNVCDAAKAPNTAGTQCFDCNIANCVKCDSPGTCAACGSGYILAKNKCEPCTVIGCKTCTDGGDGQTCTECMDSTQKISADKSKCVACGVENCVSCNEDDVCAQCAEGYEILDSGRTCTEKAAGKCKVSSCKACSKDKKTCTECEPGKHLTPTKKACLADCPAGTYLLEQACTPCDPSCAECSGAGASRCTACPAGKMLRYADEGKPTDGTCAEGCVEGPECEACGLTIGGTKYCSKCAADRWAPRNGVCADTAAARSPFCTSASGGACTQCAGGYFLQDGGCYQTTRLPGKSVCRTDNNSGKCRECANGLAAESDICPLCDSTCATCSVKSDPAKCKTCPPGRYLDAGNACKPCTETSGSIQGVADCVSCAPPSGDTGSVLCYLMKDDGTGGSTNKSGGLPPGAIAGIAVAAIVVIGGLVGFLCWWFLCRGKA

SEQ ID NO: 441 - protein, 470 aa, Giardia intestinalis
MIFVWIVFGGALAACREGILDGDCFLLSCDVILDQVYCSVCTAMTEFLIDGQCLPTNVDNTCRHSFGNGTCDSCAGPYLSYRGGCYRVGEDPGNFICKPEDVFYVDGTALCRKCVVYGEFPIDGSCTKKAQGNRCGTKGYEGVCETCGTGYFYHNGGCYRKNRFPGNKICADSSAIEHVGHCGTCLAGYETYKGKCLACEDIHCRKCGVSMSNCEVCHDGYYLDRDMNEGKGACIPCNPISNCETCLTDGECTSCARGFFAGFLGVSGRCVSCDKGGDGYAGVPHCQVCLPPHPDTSDLAAFCTECTDGFYLLVSDDKAQTSCVVSCPKNKIHYSNRCVTELEGCHNYGRNDECVKCVSGYRLTDGVCERCTVDNCEMCVSSSSVCDACKAGYGLEDGICNLCGEGCRTCDGDISVCTTCLLRFNYISPGKNCCISTCPEHSREVFDGELGFCECYGSYKPSIDGLRCEK

SEQ ID NO: 442 - protein, 198 aa, Giardia intestinalis
MLDKLLFVSFTLQLAQATRVVEKTKVDPTPCDAADPGATNCDAGNCDVTINSKTYCSKCKSGYVPVNGACTLQAQATMCTPGSGGAEGTCTACTNTQGLYMGGCYDDCPYGDGVAPNTCADAPAGCNIPNCKSCPDGTCTECNDGFVLGNGNKCVASSVNKSGGLSTGAIAGISVAVVIVVGGLVGFLCWWFLCRGKA

SEQ ID NO: 443 - protein, 699 aa, Giardia intestinalis
MFKTILFVSLILQVTLAAAQTCIPNESGKGKCKTCDAIIGTDSYCSECAQEGEVPIDGVCIGKDDPGVATAGCQNSGGTPIATEKVCGQCSDGYFLHKGGCYSVEAEKPGHTICTAATKGVCTLEANGYFATPKISIEGVSVVVCSDIVGATIDGIKYKGVADCIQCSPPPGSLGTREDKVAVCSRCKGEKYLKTDGTCANDSSGCTVFTEFAKADPENGNKCILYRDTTAGGIQYCEECSLAADQGKAALITCFACGSSKKLSPGKTSCMDACPAHSNDKATPNICECDDGYTPDEAGTQCTGTPLPPPPSDCPVENCQKCSADKKTCEECKDKNYLTPTKMCIDRCEYITGYYSGTEGGKGVCKKCDIENCFVCGPDGKCDFCNDGFYADGAGVCQKCDESCKTCDGGASTDCLDCGNGKIMSYINDIKGSCIPECTQGSGAGSCETCGLTINGAKYCSKCSQGNEYPQNGVCTTKARAAPTCKDDTIESGVCKVCADGFFKMNGGCYSTAQLPGLMVCDIATPTGGSCQVYSEEGYSLDGSGNVIDCPANCGGCRDKSTCTVCMDGYVLVASSNTCLPCSTGCAMCYPGADKCIACLSGYYLSGTACVKCTESSNNGNEVIGVADCLNCKVPSSAGPVICYAKKDSTSNDDDGTGGSTNRGGLSTGAIAGISVAAVVVVGGLVGFLCWWFLCRGKA

SEQ ID NO: 444 - protein, 572 aa, Giardia intestinalis
MLITFLIMLNTFAANCRRNRDHAVTCKSGSCELIDGMEVCTQCKAGGVPIDGFCWPFSSPQVITAGCTKGDGADLDSTATTCGKCSGADHFLFIGGCYDQKKWIGGTICTTASGGECTVCARANWLFENPSGTPAPGTKCILCSDTNGDGKVRGMENCVTCQTPGNSPGISTCDICRIGYANDGDTCVQCGDGCSACLADTPTQCTACFYGKYLKADKCVDASGCGDGNYADPKTNECKPCGIAECATCEYNATIGKPQCKTCNPSTKMVKTAADGVTTCVDESGCTSGNTHFVTDSGSKACVPCSDIKSGGVAGCSTCTAKGQCSTCLSGYFGSSSCEKCGANCATCTQAGDTNCQTCKPGYFFKSGSGPGQCFPCDSKADKGIEGCSQCSNGPTPTCTKCKPNYYKQMGNTVTCKKFCEDSTACGGTAGTCGAIVVQDTGDFLHYCSLCGDPNTFPIDGICVKEKSGNTCENGVCTQCAAGYFLYMGGCYSAASAPGNLMCKTAEGGKCTAPNENNKYFLVPGAASNQQSVMACENPLGTAVGEKAYVGVEGCDTCTAPAPPHRGWHEAC

SEQ ID NO: 445 - protein, 616 aa, Giardia intestinalis
MNALFYQLLGKWNHRQNVCFHVGSNLKRTSMLLIAFSFVLSALAAACTQPANIQNCVEEKCEMNDTEVCTQCKADGGAPYLKDGTCVTVDDCRQAAGYYPDDTTDSQNKKCMTCDSTCATCSGAGADKCTKCKPDAGDGKQYLKDGTCVTILGCAYDNEHYADDGTKECKVCNGGKRPDTVGTKCFSCPDKNCERCDQDNVCAKCNTGEPPTDGACPVAERGCHPSCGECTSDAMTNQADKCTSCKGDNYLRVIASGSGICIPASICASDKSYFAKEVAESTGPKKMCLSCSDATHGIADCKKCSSEASSAQTKLVLVCSDCDIKWLSPLGNACLEECPAGTYSERGTDNIGVCAPCHDTCAECDGNAEATSCRACYPGSVLSKGANGATGACIPECTGKYAENCADGQCTAVVGGSRYCSRCRAGFVPVDGVCVSATARAPTGCTPGNGVCTSCTATYFLESGGCYNARAFPGSTLCTTASDGKCTNCANGQEKDGQGSCPACPDGCSKCATSGSPKACSECLPGYYKSGNSCIKCDANDSQITGVSGCLSCAPPSGNQGSVICYITKDGGSGGGNTNKSGLSTGAIAGIAVAVVVVVGGLVGFLCWWFICRGKA

SEQ ID NO: 446 - protein, 971 aa, Giardia intestinalis
MLITFLIMLNTFAANCRRNRNHAATCKLGSCELVGGIEVCTECKAGGVPIDGFCRPVGSPRVITAGCIGPEDATLDKAATTCGRCNGADHFLFMGGCYEQKMGIGGIICTATSSGECVTCATTTWLFENPSGTPAPGTKCILCSDVNGDGKAKGVADCATCQAPDSSPGVATCDICRAGYANDGDTCVQCGDGCSACLADTPTQCTACFYGKYLKADKCVDASGCSDGNYADPKTNKCTECGIDGCATCEYNATIGKPQCKTCNPSTKMVKTAADGVTTCVDESGCTSGNTHFVTDSGSKACVPCSDIKSGGVAGCSTCTAKGQCSTCLSGYFGSSSCEECGANCATCTQAGDTNCQTCKPGYFFKSGSGPGQCFPCDSKADKGIEGCSQCSNGPTPTCTKCKPNYYKQMGNTVTCKKFCEDSTACGGTAGTCGAIVIQNTGDFLRYCSLCGDPNTFPIDGICVKEKSGNTCENGVCTQCAAGYFLYMGGCYSAASAPGNLMCKTAEGGKCTAPNENNKYFLVPGAASNQQSVMACENPLGTAVGEKAYVGVEGCDTCTAPAPLTEAGMRPARCTACNLGSGKPNLAGSGCFKCNIPTCSHCGANGVCEACTSEEQRPNTDGTKCISCNIDGCTRCSAENKCDQCGDGYRLEGEACVQIQPNPCKTENCQECTNKGTANEVCTECISTHYLTPTSKCVLDCTAISGYYGDANKKCKRCHDACAECVGAASNQCSACPAGRMLQYTNTNTPAYGGTCVDQCSVSTTTEGCAECGAKIGGTDYCSQCSVDNQAPLNGNCAVNTRAAFCATITGGACTKCNEGYFLKDGGCYQTDRQPGKQVCSSAQGGACNQCANGLQAQGGACGACHSTCATCSAAGAADKCKTCATGYYKTSDNEGSCRKCSEGLVGCRQCTASATAFVCLEMSDNTSGNVNKSGLSTGAIAGITAVAVIVVGGLVSFLCWWFIYRGKART

SEQ ID NO: 447 - protein, 625 aa, Giardia intestinalis
MNALFYQLLGKWNHRQNVCFHVGSNLKRTSMLLIAFSFVLSALAAACTQQTNPQDCTENKCEMIGNTEVCTQCKAGKVPINGACADPAGSSAKCKNADNSGNADQTCGKCLGATFMYKGGCYDRESAPGNVICKTPGDTDGVCDECQDGYFRHSTPVDTKDSCISCDDTAGVDHNKGIANCKTCVSPGSAGTADTPQTATCTGEAADKCTSCTAGTHFLGATSGEGPCVSCGTVQATWSGVKDCAKCNEPADADTPAVCTECAANLYVKADVGVMACVAASECGEGFFPATVGGVKKCVSCDETDNGGVETCAKCALKTPVPEAGTVVTCSECDGSKKLSPLKDACLNSCPDGTYDKQNVCAPCHSSCASCTDATSATCTACYPGFVLNATAGASAGTCVQECTGKYAENCADGQCTAVVGGSKYCSKCRAGFAPVDGVCVSSTTTRAPTGCTPGTDGTCTACTDTYFLQSGGCYQSTKYPGNTLCSNAASGKCTQCTNGQQADNNSGSCPACDPTCKTCTAKEDPNACSACFPGYYKSGNSCIKCDANDSQITGVSGCLSCAPPSGNQGSVICYITKDGGSGGGNTNKSGLSTGAIAGISVAAIVVVGGLVGFLCWWFICRGRA

SEQ ID NO: 448 - protein, 834 aa, Giardia intestinalis
MLHLIKKLMLGFLSILLLVSFCKDSRDTYYNGFGVACNDTQTNCAKDRCLSIGLWTPCTQCVPGYVPINGTCQKYPRDSSPPCTPDDPVSPTRCVVCKQEANTFLFYGSCYTIATTQDKDLGDFLCSRASGGVCAECYGDKHERYVFTNPDQTAAEKCILCSDTVGFNGYKGVSGCLDCLPPITEKVGTALCARCSYTNEDKHYYPIDYKCQASGPHGCINGYCTSCYKTHLFYKFGCYSRRSSTGLAICAEANQYELDNVTICRECANSSYAPEDGKCTLVKNGISPSDSFSECKKDDTRGLCTGCSNSEDYFLFYGGCYNKRRAPGSKLCSTVVSGACTEWKMQFDFIFNKSDNSGGYLCGDTTNGGISGCATCSYANNAVTCKRCSAGYLGVDGRFCGESCSGSTQGTCSEVVEGSSSVKILSCRCVCKPTFYNNSGTCASCTNSCAVCKDSTSTGCQQCSPGKILNFSIASSESADCINQCVVGSECAECGLAIDGSRYCTRCKDSSMYPFNGVCILDAKKDAYCTAKANGVCTACSEAAFLMNGGCYTTSHYPGDTICNTKSGGKCTASREGYGISADGKLQPCAPECLECAAPGPGRCTRCPSGRLLRRASAAATGSCIEPGACADGYYADGDACLPCVVPGCRACGRTSFCTECAGELFVGLDGKACLRECSGDRVVGEVSGGTRRCWCERGFVPALDRSGCVPAAECPPGMPWCASCDGSGACLSCAAPGHNIQVDQRTCAEGCGDRASPNQGVCMCEVDAVLTRGACVSAREVARKRVAAIAGGTMAGVVVVGGLVGFLCWWFICRSKRIGASPSTTALVRSKSV

SEQ ID NO: 449 - protein, 689 aa, Giardia intestinalis
MFDKLIFASLALQLVWATQIEQIVRSATCDSTTSGSTKCTVEKCNVWIGGKDYCSQCSTDAELLIDGRCVPTTPELAKKCITDNKGKCSSCGNGYFLHRGGCYRFGAAPGNAVCNEPSASGDSLLAGVCTSCGLGYFKNPAENAASTPPCIACNDTAGNSGNTGLVGCSTCNPPVSGQATCTACLDGFFGIGEGAVTCTECTGECKTCKGGANQCTSCKTSSKYLKITDSVAGTGECIDQGQCTETHFATVDDGINMCYLCNNTDKGGKVGCRTCTKSGTVTCKTCLDGFFGTTDCVACHENCLTCKAEAAKCTSCKADTKPYFKEGADGDQTGTCVDETECKGDHFPATDTGSANKKVCVPCGKADKGGITNCKTCAFKVSSTREGPAITCTECATDNLSPLKDECMAACPAGTYANSNVCAPCHKSCASCQANDKETSCTACYPGHSLLYGVRGATGTCVKECTGEFGANCADGQCTADVGGAKYCAQCKDGYAPIDGVCTAVTAGRDASMCTAAGGKCTACKGSYALISGGCYGTRKLPGSAVCTAASNGDCSACANGQQPSGKACPACPACPAGCSKCAAGSSPQQCSECLPGYYKSGTKCVACDKDDEANIKGVPDCVSCKEPAGSGTVICYVTQQRTDDGTGGSTNKSGLSTGAIAGIAIAVVVVVGRLVGFLCWWFICRGRA

SEQ ID NO: 450 - protein, 585 aa, Giardia intestinalis
MAATCGKCGSECFLFMGGCYRTGSQPGSEICTAAEGGKCTVCKTDNGLFKNPAAPQRPGSECILCWDTEGDGATKGVKDCATCTAPQSAAAATCKTCKAGFSGTSSCTPCTGDCTTCTESSPTECTSCKDGKYLKRSQCVAKGECTTDHYPDDTGMECVACSTIDSCTQCTFDLTTKKPKCTNCGISKKVKTELDGTTTCVDIATGCEDENHFKDGDTACLLCGDVKGVPNCETCSGAKACTKCLPGFFRVSETSCTACGDNCATCSEAGNANRCLTCKSGFFLITENESKKCVPCDSKTDDGIDGCAECDNSKGSLKCTKCKPNRKPAGKEGDYTCTVKNCEDDTLCGGTAGACNAIILDAQGKEFHYCSFCGESSKFPIDGVCASNGDKAGNTCADGVCTQCTTGYFLYMGGCYKAAGPPGSLVCKAAGDGVCTEAAAGYFVPPSPTKDKQSALSCSNPLGVELADQKAYAGVEGCSRCTAPAQLEASGMAAATCTACGEGRKPNKSGTGCAACSDANCKHCRVDGVCEECSSGFSLEGGKCVSTGGPNLSTGAIAGISVAAIVVVGGLVGFLCWWFICRGKA

SEQ ID NO: 451 - protein, 478 aa, Giardia intestinalis
MLLLALCFALSTLAVQCRGSQHSSCAAGQCKVVRGVEVCTRCRAGHVLVNGMCTSNSAGYEVVSECAVANCERCNADKVHCDQCAEGFEANSDNTQCTKAPEQQCSTPDCKACDNPRTDREVCTECLSDKYLTPTNQCIDHCEYILGYYSGIDNGKKVCKKCEVPHCLLCRGDGTCYFCEDGFYTNSARSCQKCDDSCKNCEGNTANDCVECKQGTVLDYANGQKGKCVPECVVNADKASGNCKTCDLIVEGTRYCSACSKDDEYPQNGICAPKPSGRAAACTSQGTGVCNTCADGLLRMNGGCYEDEKYPGQSVCATVASTGGTCDSPMPGFKLDNNNNLITCPEGCETCSTADQCTKCVDGYVAVGSVCTKCHESCVICTTNAATCKACALGYYKESNSDGPCKKCSEGLAGCKQCTVSVNGKFICLEMGDGTGGNTNKSGGLPPGAIAGIAVAVIIVVGGLVGFLCWWFLCRGKA

SEQ ID NO: 452 - protein, 128 aa, Giardia intestinalis
MLLVLLLIYMVAQANCTPALTGAGCATCTGQGDSQTCLTCNPLANKVQPGGKKCGDGCPANSTPKGNLCECNGGYRPNAEQGQCISSSVNKSGGLSTGAIAGISVAVVIVVGGLVGFLCWWFLCRGKA

SEQ ID NO: 453 - protein, 363 aa, Giardia intestinalis
MLVVLLLICINVLAKYSGRETCEPATGVCDGSLSKAGCATCTAAGSDQTCLSCTTSSHKIRPDEKGCIAACPEGVSTDVDGFCECKNGYQPSASGETCELDACNTPNCKACDNPKTDREVCTECNDGNYLTPTSQCVPDCTVISGYYGDADKKCKKCHDACTECIGAASNQCSACPAGMMLQYTNTNTPAYGGTCVDQCSVSATTEGCAECGARIGGTDYCSKCKGGQVSVDGVCAANTKRNVICTTLSDGVCSACTEGYFLFAGGCYKTGQQPGKQVCSNAVGGKCTKCASGIDVVDGDCSTRKCHESCETCTTANDPNACTTCNTGYYKPQKCWDKVQSVFRGARRVQAVHSVICQCVHVP

SEQ ID NO: 454 - protein, 460 aa, Giardia intestinalis
MKGDALQCLECRDLYLSLDKKSCLAGCPRGQKGVRDPSSSIHSCTCDDGLYLKDGGCVKCAVENCAKCNESKCSKCRYGYTLSNDQCAETKCKDPNCDACENRNVCTKCSNNYSLDQNGLCVKDCLSSAGYYKATVGDVSRCVACTLGGCAVCESADRCKTCRDGFYLESQEGCKPCSSACATCSGPEAGDCTSCPAKRRLQYSDGTKGSCVPQCVKDGSCAACGLTIDGTSYCSQCVKSTEYPRNGVCASTGSRATGITCANAFGGQCITCGPSSFRLNGGCYTSKLLPGKTVCSGERDGWCENVAAGYGITYNGTLLTCPEHCKVCTDGSCSSCNSGFYPENGVCNACPEGCATCPHGRACFDCLAGYYFSENICKACHKAVPKCSLCAVPEGATQPVCLEYGRSPRPALSAGAISGITIGAVLVIGAVTAVLVWLLVFRKRAGVPPLYKQSTVASTQ

SEQ ID NO: 455 - protein, 632 aa, Giardia intestinalis
MLLVVFYFVLIALAVACSGSAQSNCVENECATIGATIICIKCQAGNVPINGICKPKAENVETCKKANDSEADQTCEKCNNGYFLYKNGCYQFGNDVARLICNDQAVVPGGRNNPVAGVCTECNTSGGFFKNPEAADTTDSCIACNDTTGVQVNGGNTYKGVQNCVVCGAPGTGTGNEQKIAACTACEDGFFVTSNGATCTQCKDTANCAKCDAGADKCTKCKTTATNKYFKDGGDGTGTCVNEQACKEQNTHFPKDDPNNGNKCLSCSDDKSGGIADCKTCTLKEKPEGSILVTCSSCTAGTNKPNIDGTKCIACAVKDCAKCNDDGTCAECNDSKKLSPLGDACLEKCPAGTYVDSNGGISVCTLCHNTCAECNGSADATACTACYPEYSLLYDSSTTGTCVKECTGQFSANCAEATCSAKVGGSSYCAQCKDGYAPIDGVCTEIKAPAGRNQDICTASGGKCTACKGAYALISDGCYSVNKLPGKSVCTAANDGKCSICANEQAHSEGKCPACSDGCLKCKTNVAACTECYSGYYLFNSKCFKCTNGNEADIKGVENCISCAPPTGDTGPVVCYIKNDGTSGGGGSSGGGSTNKSGLSTGAIAGIAVAAIVVVGGLVGFLCWWFLCRGKA

SEQ ID NO: 456 - protein, 585 aa, Giardia intestinalis
MLLLALCFALSTLAVQCRGSQHSSCAAGQCKVVRGVEVCTRCRAGHVLVNGVCTGNSAGNEAEPECAIPDCAQCNADDPAKCDKCRDGYSPNQEKTQCDKDPEPECAIPDCAQCNADDPAKCDKCRDGYSPNQEKTQCDKDPEPECAIPDCAQCNADDPAKCDKCRDGYSPNQEKTQCDKDPEPECAIPDCAQCNADDPAKCDKCRDGYSPNQEKTQCDKDPEPECAIPDCAQCNADDPAKCDKCRDGYSPNQEKTQCDKDPEQQCNTPNCKACDNPRTDREVCTECSEGNYLTPTKQCTQSCGTLGGYYNGDKVCEPCDPSCAACTTKGPTKCTLCPPGKRLQYTDEGAPQGGGSCVDECRPEGGAGGCETCGATIGGTKYCSKCSTSSEYPVNGVCTADNARAVVCVTKDGKGGCTTCDNGYFLQDGGCYKLGRQPGEQVCTVAGNDGQCQTCANGLEAQAGDCLRSACHPTCKMCSAADASTACTMCATGYYMVGAGPKACTSCEADSGSVKGVSGCLNCAPPSGDTGSVLCYLTKDDGTGGSTNKSGLTTGAIAGISVAVVIVVGGLVGFLCWWFLCRGKA

SEQ ID NO: 457 - protein, 255 aa, Giardia intestinalis
MSGSVTCTKVCEDETACGGTAGACNAIVVGADGKGMNYCSYCGGADDVPIDGRCVNKANANDNTECTAHKCPSCAAADYFLYMGGCYSTKKEPGNLICTEAKDGKCIAPTSRYFAVPDAAKTGQSVLACGNPLGTAVDDKTYVGVEGCSRCTAPARLEASGMASATCTACGEGRKPSKSGTGCVACSVENCRHCKADEKCEACNEGFSLEGGKCVSTGGPNLSTGAIAGISVAAIVVVGGLVGFLCWWFLCRGKA

SEQ ID NO: 458 - protein, 465 aa, Giardia intestinalis
MCAMWLAASGGCFHCLPNRYSSFKLAASILRRAMLYLTALVLIGLASADPPAPKQCNGAVPQCVADGENCLNIKIDGSPKDVCIKCEPNNVPIDGACKAAADNTNSCVTPDSGAGGVCASCQGESYLYKGGCYTACPQGTPNPETNTCDGVPAPDCNIPNCEACSEDKKTCTTCQPGHLLTPEKNACLGACPAGSYAAGQACTPCDPSCAECSGAGASRCTACPAGKMLRYADEGKLNEGGQCVEGCVEGPECETCGLTIGGTKYCSKCKGSSVPLNGVCTSNAARAQFCTTAADGACTVCAAGYFIQGGGCYETTRQPGEQICALTDNKGKCQTCANGLGPDGAGTCPSCDPTCKTCSAANQENKCTTCATGYYKTALEGVCTSCESDSNGVTGVRNCLNCAPPSTGSGSVLCYLMKGGDSTGGSTNKSGLTTGAIAGISVAVVIVVGGLVGFLCWWFLCRGKA

SEQ ID NO: 459 - protein, 460 aa, Giardia intestinalis
MLSFLWIGLILQLVRAEDECTPTPSGGFGTCRTCGAIINGKEYCSQCNGSGSFDSGCAPTDGVCTSDNNECAQKQDGVCTRCAYSSFMYKGGCYQSSRAPGNTVCETAQDGKCTTARVGYFVPPGADASHQSVIPCGDEEVVTIGSSKQYRGIPNCLTCTAPVNGDGADSTPKAPTCNACKDGFFVDASKESTCTACPANCLTCADGTAERCKSCTADTHFLGAADDGEGPCISCGDATQGSGAWRGVAGCAKCTKPQSAGPATCTECAADKHLKTDSGATSCVSAGECKDGFFPTTDSTGKRVCTTCGDTANGGIEDCAKCSLKAASAGAGPLVTCSECSSKKLSPLGDACLTACPAGTYPNDNGVCAPCHSSCVSCKNSSAEASCTACYPGSVLSRTSGDAGRCTPECTGEFVAHCAAGQCDGVVGGSKYCKKCDNGYVPINGICTAAGAAGRGASVC

SEQ ID NO: 460 - protein, 750 aa, Giardia intestinalis
MMLVILTDGSRRRVFSPEHAPLSLEPYHDLCYTTMLLVAFYFAISTLAEACQPDGDHAVTCQTDKCETVGDAEICTQCKAGGVPIDGFCWPFNAPQVVLAGCTGKDGADLASSATVCEKCDSGYFLFMGGCFKKGSESSQTLGDSICETAQDGRCTKCKADGNVFQNNADTVTLGNECVLCSDITQRDGVMGVAKCLQCTAPNSKKGAATCTACADGSFVSNKACVDCNQNCATCTGSTQNECASCKDGKYLKEDTHTCVAGTGDTCGANNYADKRTWRCKSCTEITDCDTCVYDEQLNGPKCKTCGSSKIVQTEIDGRASCVELNTCTENGQPGTHFRSDGNKKCIACSDTTTEVAQKDQGIAKCKTCTKADGATQPVCSVCLDGFYFDTTCKPCERNCKTCSAQNTCIDCIDGYFLNINACAEKCAEHCATCKKAGDINACTKCMPGYFLIDSTEGIKECALCTEVSKGGREGCSACSNTGGFKCTDCKANYQKEGSPDNCACRKTCEDETACGGTAGACDAKIVDSTGKTLNYCSLCGNPAAFPIDGKCTASKEGNQCSQGVCTQCAQGYFLYMGGCYSTANPPGNLMCKTANGGICTEAASDKYFAVFGAAKTDQSVLACGNPLGTAVGEKTYVGVLDCIACTGPEALVTDGMAAATCTACGEGRKPNKSGTGCAACSDANCRHCRVDGVCEECSSGFSLEGGKCVSTGGPNLSTGAIAGISVAAIVVVGGLVGFLCWWFICRGKA

SEQ ID NO: 461 - protein, 531 aa, Giardia intestinalis
MLVGVILLFAVAVSQCTPGENGCDTCDSGNTKCTKCTAGSGNGSDQEYLTDDGRCVTKAECVAGNGHYVVNEPDPSSGRMCKACAKDTKPNIDGTQCFICPDANCERCNQNNVCARCNNGEPPADGACPVAGKGCHSSCDGCTEDAMTNQANKCTGCKEGLYLKPEPTDGQSGTCLTAADCTSDQTHFTKEKAGDSKKMCLPCNDATHGITDCKKCTLKTLSEGAEPIVVCSECADKWLTPPGNACLESCPAGTHVDNVNGVSVCTPCHDTCAECNGNADAASCTACYPGYSLLYGSGIAGTCVKECTGEFGANCADGQCTADIGGAKYCAQCKDGYAPIDGICTAVTPAGRASVCTAAGGKCTACTGDYALMSGGCYGVAKLPGKSICTLASNGKCTMCAANKQAPIQEKCPECSEGCAKCADSNACTECYSGYYKGAGNKCFKCTANDNNGIEGVPNCVSCAPPSGNQGPVTCYVKADGTSGGDDGTGGSTNKSGLSTGAIAGIAVAVVIVIGGLVGFLCWWFICRGKA

SEQ ID NO: 462 - protein, 414 aa, Giardia intestinalis
MLLIAVYFVLNALAAECSEAHRATCGNGKCEKIGDTEICTECGANGNVPINGICKAHGSEETGAAGCKNGSDLSPSDVKVCIKCVSTNYFLFKGGCYKVDEVPGNTICQTAGAAGTCDVCKDGYFKNPVESLDNTKQSCIACNDTEGADYNIGVLNCAMCVAPETPGTSGGDKKSATCKSCLEGYYAENPLTCTQCEDNNCAICLGAGTGKCTKCKSGPGTGKEYLKITDIPGKSGECVEASKCTGTHFPATDSGNNKVCVLCSDVDNNGVAGCNTCTSTPISDSSNMVTVKCTECTTPKTNKPNVAGTGCFTCSIDGCDNCSENGVCEKCGNAKKVSPGKNSCVEQCPENSIEKESVCVCNSGYGPDSAGTGCVTVSTNLSTGAIASISVAAIVVVGGLVGFLCWWFICRGKA

SEQ ID NO: 463 - protein, 483 aa, Giardia intestinalis
MQPISNNIGVALCTRCNYAEKDNGISPIDYQCQAKGLHNCINGYCTSCYKTHLPYSGGCYSRHTATGFAVCAEANQYELDNVTVCTECADTSHAPRNGACTLVSASGSLFSDCTKDADRGLCTGCSSAGKSFLFYGGCYDRSSHIGSRLCSEVAGGACKQWRSSFDFTFSKAGGTDRYLCGDANNGVHGCATCRYGNGVECTRCSAGYLGVDGRSCGKDCSGSTQGACSEVVEESSSVKVLSCRCVCKPTFYNNSGTCASCTDSCAVCKDGTSTGCQQCSPGKILNFSIASSESADCVNQCVAGSECAGCGLTIDGSRYCTRCKDSSTYPFNGVCVPDAQEDAYCAIYENGVCTACSEAAFLMSGGATQQHTIQATPSAMQRRVASARHPGGPADVRRGVWGQGSSDQGVCVCEIGTVLMRGVCASTRDAAKKKTAAIAAGATAGILVVGALAGFLCWWFICRRKRASFSSSCTTLIPPSKPM

SEQ ID NO: 464 - protein, 536 aa, Giardia intestinalis
MYKGGCYRTGQEPGNAACARAAAGVCTQAAQGYFVPPGADASHQSVIPCGDVEEITVKDGKKYRGVPHCLQCNPPGPAQNASAVPALCTACEDGYLDFDDRCVACHKSCRTCESSNTEDGCTSCTAETYFLGAASGGEGRCIKCDDTTGAGSYKGIAGCLKCTQPESAGPAVCTECAANLYVKADVGVMACVAASECGEGFFPATVGGVKKCVSCDEIGNGGVGDCAKCALKTPVPEAGIKVTCSECDRNKKVSPLKDECMDSCPDGTYDKQNVCTPCHSSCASCTDATSATCTACYPGFVLNAAAGASAGTCVQECTGRYAENCADGQCTAVVGGSKYCSRCTTGYVPVNGICISSTTRAPTGCTPGDGICTACTDKYFLESGGCYQSTTYPGNKLCTTAAAGKCATCANGQTANGQGSCPACASTCATCASGNVDQCQTCFPGYYKSGNSCIRCDANDSKITGVSGCLSCAPPSSNQGSVICYVTKDGGSGGDSTNKSGGLSTGAIAGIAVAVVVVVGGLVGFLCWWFICRGRG

SEQ ID NO: 465 - protein, 436 aa, Giardia intestinalis
MLYIAVLAFTWLALADLAPKSCDGDGATSCAPGTNCLDVKVAGQPKEVCTKCESTHVPIDGACKPKAPEEDKCSRPTEGDDGTCAACKGAYYLYKGGCYTKCPQGTPNSETNTCDGAPAPDCNVPNCDTCSEDKRTCEACRSGYFLTPEKNDCLISCPGGSYATGRTCTPCHSTCSSCSDATENSCTTCYPGSVLSRNGGKATGACIPECTGGYAENCEATRCTAVVGGSKYCSKCRTGYAPVDGICVSTASRAPAGCTPGDGVCDACTGTYFLQSGGCYNAGTFPGNTSCIVASGDGKCATCANGQDADPQTGSCPSCPANCSKCSGDSSAKTCTECYSGYYLDAGKVCKKCSETSGNIQGVPSCMSCKAPSSPSALTPVTCYVTQQRTDDGAGGSVNKGGLSTGAIAGIAVAVVIVVGGLVGFLCWWFLCRGKA

SEQ ID NO: 466 - protein, 633 aa, Giardia intestinalis; identical to SEQ ID NO: 14

SEQ ID NO: 467 - protein, 615 aa, Giardia intestinalis
MFEKIIFGIAILQVVWAATTCTEASSDPQTGQCATGKCDVWIGGSNFCSQCSTAAEHLINGKCVPEGEDTEGKCTAKNDGTCESCKAGFFLHRGGCYEMGSDIGLLVCNDRTATADKDGICIACHDGYFKNPASDADKTKESCIACNNTAGVDHNKGVQNCATCDAPKTPGQSSAEQTATCKSCVDGYYGTTSCQQCHADCRTCTGNGEDKCTSCKDTGKQYFKEGANSDGTGTCVDENGCGNTHFPIAEDKKCHLCGSVSEGGVADCKTCSKTGDSVKCLTCEGTKKPNEAGTGCFVCPMEHCEKCSKDNVCEACGSEKKLSPLGDACLDACPAGTRTDANVCNLCHESCASCSTNAEASCTACYPGYVLNRSSDDTGTCIKECTGDFMAHCKADGCSLNVGGSKYCDQCEEGYAPVDGVCTSIPAAARDASGCKASGGKCTECGANYALLSGGCYNTQKLPGSSVCTAAQNKGQCQTCANGQSPAGRKCPACTEGCVKCAGSKETCTDCLAGYYKDAGDKCFKCTDSDKASSNAITGVENCISCAPPAGGNGPVTCYVTQQKADDGTGGDTGGDSTNRSGLSTGAIAGISVAVIVVGGLVGFLCWWFICRGKA

SEQ ID NO: 468 - protein, 705 aa, Giardia intestinalis
MITVIGTGDVRGAVLEMSQRPFSPWSLETPHTGEATRTPEIRYTGACLWGAHYPHSPRGSVTWCCVLYGLPAMFEKIIFGIAILQVVWAATTCTEASSDPQTGQCATGKCDVWIGGSNFCSQCSTAAEYLINGLCYPDNKDNGCEGQPSTGVCTQCAQGFFLHRGGCYKIGTEPGNLICEDTQASQTQGVCEACSSGYFKNPAADAAGTPPCIACNDTVGNSNNVGIANCKTCASPSAAGTENAPQTATCTACVDGFSPDSTGKTCVAVQCAENCLTCTSSGEDKCKSCKDGYFLGAASGGEGKCIKCNDTTGANSYKGIANCAKCTQPQSAGPAVCTECAADLYLKIDRGVMECVAAAGCGEGFFPTTVGGVKKCIGCSEAGNGGIDKCAKCTLKTPAPEAGVKVTCSECDSQKKLSPLKDECMDSCPAGTYDKQNVCTPCHSSCASCTDATSTTCTACYPGFVLNAASGASAGTCIPECTGQYAENCADGQCTAIVGGSKYCSKCKAGYVPVDGVCVSTTTRAVTGCTPGDGVCTACTGSYFLQSGGCYQSTTYPGNTLCSSATNGKCQTCANGQTADNQGSCPACPDGCSKCTGSASPQQCQTCLPGYYKSGDSCVKCDASANGIVGVPNCISCAPPAGGSGSVTCYVKTDGTSGGDDNTGGSANRSGLSTGAIAGISVAVIVVVAGLVGFLCWWFICRGKA

SEQ ID NO: 469 - protein, 692 aa, Giardia intestinalis
MFDKLIFASLALQLTWATQVKRMVRSATCDSTTSGSTKCAAEKCNVWIGGKDYCSQCSTDAELLIDGGCAPTTSDLAKKCISDNKGKCSSCGDGYFLHKGGCYKFGTAPGNAVCTEPSAPGDSLPAGVCTTCGSGYFKNPAESAASTPPCIACNDTAGNSGNTGLVGCGTCDPPVSGQATCTSCLDGFFGIGEGTVTCTECTGECKTCKGGADQCTSCKTSSKYLKITDSVAETGECIDQGQCTETHFAMVDGGINMCYLCNTTDKGGKVGCRTCTKSGTVTCKTCLDGFFGTTDCVACHEDCLTCKIEAAKCTSCKADTKPYFKEGADNDQTGTCVDEVECKGDHFSTIDTSNSDKKICVPCSKTDKGGITNCKTCAFKVSSTEERPAITCTECTTNNLSPLKDECMAACPAGTYANNKVCASCHSSCAGCQTDDRETSCTACYPGYSLLYEPNGATGRCVKECTGAFITNCADGQCTADVGGAKYCAQCKDGYAPIDGICTTMAAAGRDASVCTAAGGKCTACTGDYALVSGGCYGIQKLPGKAICIAANNGECTTCANGQQPSGKVCPTCPAGCSKCTGSAPSQQCSECFPGYYKSGDKCVKCDKDSENIKGVPNCVSCKEPANSSGAVTCYLTQQKTDDGTGGDTGGDSMNKSGLSTGAIAGISVAVIVVVGGLVGFLCWWFICRGKA

SEQ ID NO: 470 - protein, 445 aa, Giardia intestinalis
MLIGFLLVCATVLAKHNEKGSSANCNTPNCRDCTNPKAENEACTDCDPAYVLNGGQCVEKACNTPNCKACDNPKTDNEVCTACDPAYVLNGGQCVEKACNTPNCKACDNPKTDNEVCTACDPAYVLNGGQCVEKACNTPNCKACDNPKTDNEVCTKCNDGDYLTPTNQCVPDCTAISGYYGDSDKKCKACNPECAECVGPANNQCTACPVGKMLQYTDTNTPVNGGTCMDQCSVSSTNDGCAECGAQIGGTAYCSKCKNTQQAPLNGNCAASSRVAFCATITSGACTKCNEGYFLKDGGCYQTDRQPGKQVCSSAQGGTCQTCANGLQAQGGACGECHSTCATCSTAGDPNKCKTCATGYYKENGDDTTAGLCKKCSEKISGCKQCVSSSGSSVICLESEVGTGGSVNKSGLSTGAIAGISVAVVVVVGGLVGFLCWWFVCRGKA

SEQ ID NO: 471 - protein, 547 aa, Giardia intestinalis
MFYAFLLTGLALELVRAAQAGDECEEVASSEPNTCKACSAVVNGKKYCSQCNGGGSQSAPTDGVCSADNNECTRKQDGKCTQCANKSFMYKGGCYKDSQAPGNTMCETANAGVCTQAKEGYFLPPGTDNAHDSVVSCGDTTGVTLTGDKKYTGVAECVTCTQPGQLSIGGTKAAICTKCAADLYLKIDRGVMECVAESGCGEGFFPTIVDGVKKCAGCSEAGSGGIEDCELCIPRAPAPEAGVKVTCSKCHASKKVSPLKDECMDNCPAGTYDKQNVCTPCHSSCASCQTDDKETSCTACYPGHSLLYEANGATGRCVKECTGAFITNCADGQCTADVGGAKYCAQCKEGYAPIDGVCTAVKIGRDASVCTAASGKCTACTGAYALISGGCYGVAKLPGKAVCTAANNGECTTCANGQQPSGKVCPTCPAGCSKCTGSAPSQQCSECFPGYYKSGTKCVACDKDDGSIKGVPNCLSCKEPASSSGAVTCYLTQQKTDDGTGGDTGGDSMNKSGLSTGAIAGISVAAIVVVGGLIGFLCWWFICRGKA

SEQ ID NO: 472 - protein, 673 aa, Giardia intestinalis
MTARLAPDQVLWIFNTISDKCIVLLAEHRIADKILFPHWHNPNRTSMLLVVFYLVLSALAAACKQAQNCVEDKCEMIGDTEICTQCTAGKVPIDGVCTAVGSAAGKCTKAEGQAVDDTDKTCGKCVDAYFMYKGGCYLAGAAGPGTGTKMCKQAAGGKCTQAADAKNYFIPPANTDDTHDSVVWCGDEIGVTLSSTQYKGVAKCLVCDAPGGAGAATCTTCEDGYFGATCEKCHESCRTCEAAEENKCKSCTDGYFLGATNGAAGKCLKCNSKTEEGWHGVDNCAKCTSSNTQNTPATCTECVANFYLKPAADATPSSCVTETGCGDGYFPTIVDEVKKCIACSAATNGGIDDCKKCSLKTTSAKAGVEIVCTECNTKWLSPLRDACLDSCPPGTHADSGNICPLCHSTCAECDGNAGANFCTVCYPGFVLKRGETGNMGMCVPECTGEYAENCEADQCTAVIGSSKYCSRCKVGFAPVDGVCVSTASRAVTGCTAGNDGTCTACTGTYFLQSGGCYQSTTYPGNTLCSIAASGKCTTCANGQTADSNLGSCPACPAGCSKCATSGSPKACSECFPGYYKSGDSCARCDTNNSQITGVANCVSCAPPSNGQGSVICYITRQETDDGTGDNTGGSTNKSGLSTGAIAGISVAVIVVVGGLVGFLCWWFICRGKA

SEQ ID NO: 473 - protein, 419 aa, Giardia intestinalis
MLLIAFYLGLSALAAQCKQVQNCAAGKCEMVGGTEICTECATNGNVPINGECTPKGNAADKCKKVNGNELVDDKTCGKCENTYFMYKGGCYQLGSDVALLICNDQAASPGGRNAVAGVCTECNATGGFFKSPEAADTTDSCISCSDTTGVQVNGGNTYKGIENCVVCAAPERGTGNENKIAACESCLEGFFVASNKAVCTRCTDNDNCAKCDAGENKCTKCKATASKPYLKKGETEDSNTCVNSNECTTDKTYFTDDTDDPTHGKMCKKCSEGIADCKKCAPSSPSALATVSAIVCTECTTQTNKPNVAGTGCFTCSVDGCSNCSENDVCEKCGPNKKVSPGRKSCVDSCPENSIDDNSVCTCSSGYSPDSSGASCVSTGSNRSGLSTGAIAGISVAVIVVVGGLIGFLCWWFVCRGKA

SEQ ID NO: 474 - protein, 593 aa, Giardia intestinalis
MLLTAFCVMASVLAATCTVEANTRDCAESKCEMVGGTEVCTECKYAGNVPINGVCKQKGDSAVTTSGCKKEDGTGLAEDKVCERCEDAYFLYKGGCYSVDNEPGQKLCIKAAEGACTEAAPGYFVPPQAIRSDQSVIACNDTISVQVLSGRSYMGIAHCTLCDSPKIASDPAPKPAVCTACEDGYFLGAAGDKESKCILCGDTSGSTWKGVDGCLKCTASGKADTPATCTECQEGKYLKGGDPTSCILRNACTGTHFPNDNAENKKKCLPCGENANGGIENCAECSLLSSVSGSATVLIKCSKCGSDKKLSPLKDACLDSCPVGTYDKQSVCTPCHSSCASCTDTTSTTCTACYSGFVLSAASGASAGTCIQECTGQYAENCADGQCTAIVGGSKYCSRCKAGYVPVDGVCVSTTTRAVTGCTPGDGVCTACTGSYFLQSGGCYQSTVYPGNTLCSSANNGKCTSCTNGQTADKNSGSCPACPDGCSKCTGSASPQQCSECLPGYYKSGDKCVKCDASANGIVGVPNCVSCAPPSNGQGSVTCYVNGSGTSRADANRSGLSPSAIAGVSVVVIIVVGGLAGFLCWWFIGRRKA

SEQ ID NO: 475 - protein, 739 aa, Giardia intestinalis
MFGSFVLAGVLVQIAWAGKATERAQEAQCADNTNCAAEACNVLIGGKLYCSRCNTGFVPINGQCADKEGATDKCKDGSGGDTADQTCGQCAEQTFMYKGGCYEAAQQPGQTMCQAADAGVCTQAAQGYFVPPGADASHQSVIPCGDEEEITVKNDKKYKGVLHCTRCNAPTEAADANAKAATCTACQADRYLKTAKDQATSCVTEQECTGTEGFFAKNGGTKTCEACAETCKTCKTEAAKCTSCKDDKPYLKKDNGSDTGTCVTEAECKTGNTHYPDDTEPKTCKTCAEGTSDGCATCEKGADGAVACKTCGNQKKVQPNKKGCVENCPSNSNDKKTPGTCECVEGYVPEEAGTGCTKKPDPPAAPCNTPGCKTCSEPKTSKEVCTECEDPKALTPTGQCIYGCEHLEGYYEGTSEGGKKACKKCEVENCLLCNENGQCETCKDGYYKKETACAKCDTSCKTCANGEPNGCTSCEAKKALSYEGEGNTGTCKSECKPGTNNCEKCELTVDGTAYCSKCKDANQFPQNGVCSAAAGKAITCTTKGTGVCDKCANGLLRMNGGCYETTKFPGKSVCEEAASAGDTCQVEAPGYHLNNNDLVTCSAGCKTCTSNTVCTECMDGYAKTDNKCTKCATGCATCAGSASNCDTCSTGYYKYKNACVSCTESNSDKTITGVANCANCAPPLNNKGSVLCYLVQSGENTNKSGLSAGAIAGIAVAVIIVVGGLVGFLCWWFMCRGKA

SEQ ID NO: 476 - protein, 596 aa, Giardia intestinalis
MLLIAFYLILSTFAVDCKNSGNSCEAGQCDTIGDTEICMQCNQGKVPINGICTAHSEEAVTNAGCKKNGGTNIEESDKVCGQCGNGYFLHKGGCYKIGEAPGNLICADEASNPGARTAGVCGACKDGYYKNSDAVATADSCIACEDANCATCGGAGENKCTKCIDGYFVGATGNEGGCIKCDATTGPNSYKGVAGCAKCEKPKNAGPAKCIECAADYLKTEADEQTSCVSEAVCREGKTHFPTTDSAGGNKKVCVSCGTTNNGGIENCGECTSKESAARAGTEITCTKCSSNNLSPLGDACLTDCPAGTYAVSGDSGSVCKPCHNTCAGCQTDDRETSCTACYPGYSLLYESNGATGRCVKECTGAFITNCADGQCTANVGGAKYCTQCKDGYAPIDGICTAVAAAGRDVSVCTATGGKCTACTGNYALLSGGCYNTQTLPGKSVCKAVANSNDGKCKTCANGQAPDPATNFCPLCDSTCAECSTKNDADACTKCFPGYYKTGNKCIKCTESSNNGKKIDGIPDCLSCEAPINTGPVICYVKTDGTSDDNSGNGGDSTNKSGLSTGAIAGISVAAFVVVAGLVGFLCWWFICRGKA

SEQ ID NO: 477 - protein, 140 aa, Giardia intestinalis
SFCTNAAGGVCTQCAADHFLQDGGCYKLGRQPGVQICAAAGPNSLCTTCVNGQRPDTNTGACPVCPTGCDTCTGTSSRAPECQSCLLGYYFDSDKKLCVKCTENSSAIQGVSSCVSCAPPSNNQGSVVCYLINDSGSTNK

SEQ ID NO: 478 - protein, 147 aa, Giardia intestinalis
SGCKASGGKCTECGANYALLSGGCYNTQKLPGSSVCTAAQNKGQCQTCANGQSPAGGKCPACTEGCVKCAGSKETCTDCLAGYYKTIDNKCVKCTASSGDNNQITGVENCISCAPPAGGSGPVTCYVTQQKADDGTGGDTGGDSTNR

SEQ ID NO: 479 - protein, 139 aa, Giardia intestinalis
ECKTPANKGGCSVCASGYFLLDNGCYKTDRQPGSQVCKTEGSGKCTKCANEQTPDQQGSCPACPAGCSKCSDANTCTECLAGYYKTSANTCVKCDTDDNTIKGVPNCVSCKEPSGGSGTVTCYVTQTPAVNPTDPSVNK

SEQ ID NO: 480 - protein, 143 aa, Giardia intestinalis
ECKTPANKGGCTTCASGYFLLDNGCYKTDRQPGSQVCTAETGGKCTQCANGMTVNSQTGVCPSCDSSCKTCGATAASECASCFSGCYLDSANACKKCSENSADNKITGVKDCVSCDPPSGSGPVTCYVTQTPAIDPTDPSVNK

SEQ ID NO: 481 - protein, 520 aa, Ichthyophthirius multifiliis
MQLENNGDTKFIGSHWKELILFNELMAAESSGKDSQLSVFTIALLRDTGYYAEVNESMADDFQSGRNRGCDFVLKACQSDTQYPEFTQKKYSPDQCTSKNNGYGKVKQIDLYDNCKTVQNTFYCEDSDLNNYVNNFSFQYFGVNSKCLKSTSIQGNNKFQYSNARCHLVQCSPDSTQITITFTQQALQLLLCTKQDQGKEIQVVKGQPEFGYITCPDNYREFCNYTPECPNYCSRKGICILGQCRCSSRWSGADCNISLKNCPYFTLEEDPQKCVQQCPSDKFPNPDKVCRSNCPKSFYFSNYRNDCVECNYQCLSCSGPSKNQCLECGISKYLEEGQCVNQCSSNFILVNQRKCVKSVDQGCEQECERCDSENKVICTKCKDQYFLNLKTGKCVVANNCPQETFANEENNTCQICELTGCIQCISQTVCQVCDEQLGFFKKGDQCAKCPQGCQKCSSDLQSCTVCYSGLFLQERNCDIDCPSNKFQDQKKRECIPISICKRLFLFIKQMYKTMSQIYFQ

SEQ ID NO: 482 - protein, 1239 aa, Ichthyophthirius multifiliis
MGNNSKYKIPNPQQLSLSNKYTIDSALINVVKSQNIIFNNQYYAFYKNDFFDDDCEQVPISQNDVYEISRSCSTNKIVIFHSTDGRLGIMIYKGKKYIMSEFPEYKCILEIDDNIGLIMKSKQIISLSQFTYSGDTVTLNSKISLNSSEFYLSDILDFGIGKKIICLGNNGAWEFYDLLTFTQVYLTNDSSPIKFGKYYDILTYESIIFFGNIVYDISYDSVLNRIRVIQRADQKNKYYTLPINDHKFRQSFKKGQTLIVDDENHNDQYLYIKTIENIICNDNEYINSNLKCIQCKINEIFEGDKCVACPEGTFKLNNSDRICTECMRAMKGCISCTNLTSCTKCDKDTSIFNNPKCIACNSTCHTCEDAISCKSCADGKFLNTNTQLCEECDNSCATCTDKTKCLSCSSPLYLQQLEKKCVTECYPGYYLNTSKICQKCNRTCATCKNGASCTTCLSDHLKNEQNKLCDLLCDRTCKTCLFSKFNCLTCNDPYYLQTNHTCADSCLPNEYPDDTKTCQPCNISCLTCINGTSCSTCTDSMYLDSVTKYCKPCTTVNCKTCDNPSQQCTECNLLYYLTQDNKCVDNCQFDQHNTYGDAQRKCQLCNATCFTCQNAFSCDQCNIGYYINTISALCEKCNDNCKTCENGIVDNQCISCNNPMVLLQTKQCADVDVDLDVDIDADADNDANANKCNSKQYLDVNQICQQCDSSCNSCSNSSTCNSCVEGRYLVISTSKCDFCDLNCKACIEKDKCQSCVQNYFLTQNKQCKQECDQYTFPDSNGICQSCPSNCLNCKQFNQCIECFYGFYLYNGLCIEEVICYGNTYLEQNECKTECSQRKFKNFANNRCDPCHITCKKCTEANKCLECENGLILNDDSKCEQQLQETNATSKLIFKIYLATTIYTFISCIICHFLDNRSINSGEKECKPKVAKTQIINVENQVVVEDIISNENKIQNFQKQIQKNKQINQNKIILNFKKNNNKIDINSRKKSYFTNQTKISPISPEIDMIVFRNFKTKQTQQKTMNNQNGSTVIKFNDPNNYRNSINTITSQININPDQYNYDQKIYFTLIANEFLEVYMLQDNSPNSVLRVLLMYFKQCLIMLISFYQFIFGYFIICILILMCVLIKGILKKIIEKFNFLNCYRYIVSKIFFLVIYSLFFIFFIFKQCSIITNDKDYKWSVYYLSIFIIDFIFIQNIISFLNYCSSVRKIKGFNDKLQLFLNYTFVQQNIINEIKTNKLK

SEQ ID NO: 483 - protein, 116 aa, Giardia intestinalis
LLVCATVLAKDSGKDTCFPGYTLNTDTKQCTKDPEAPCNVEGCETCVEGNAQQCKTCRPGYTINTDTKQCTKDPEAPCNTPNCKTCDNPKTDSEICTECNDGNYLTPTNQCVPDCT

SEQ ID NO: 484 - protein, 709 aa, Giardia intestinalis
MFGRFLLAIVILQLARTACTQEADDGKCKTCGVTIGQEQYCSECNGANYAPVNGACEDVETQADKKALCKAHASGACTTCGGNSFMYKDGCYSSGEGLPGHSLCLSSDGDGVCTEAAPGYFLNPLRANTKDSVVSCSDTTGFTDSGKTYRGVQYCERCDGAALTDAAGGDAKCTRCGQDKYLKDNTCVDKAQCDSGSTNKFVAVDDSENGNKCVSCSDNLNGGVANCDTCSYDEQSKKIKCTKCTDNNYLKTTSEGTSCVQKDQCKDGFFPKDDSSAGNKCLPCNDSTDGIANCATCALVSGRSGAALVTCSACTDGYKPSADKTTCEAVSNCKTPGCKACSNEGKENEVCTDCDSSTYLTPTSQCIDSCAKIGNYYGATEGAKKICKECTAANCKTCDGQGQCQACSDGFYKNGDACSPCHESCKTCSAGTASDCTECPTGKALRYGDDGTKGTCGAGCATGTGAGACKTCGLTIDGASYCSECATATEYPQNGVCSSTTVRAAATCKAGSVAKGMCNSCTNGFLRMNGGCYETTKFPGKNVCEEAAPAGDTCQTPADGYKLNNGALITCSAGCKTCTSQDQCDTCKAGYAKTGGNTKKCVPCATGCSECNADDATKCTVCAAGYYLSKEKCIACDKSDGGSITGVANCANCAPPTNNKGPVLCYLIQNTNRSGLSTGAIAGISVAVVAVVGGLVGFLCWWFLCRGKA

SEQ ID NO: 485 - protein, 645 aa, Giardia intestinalis
MLVGFLLVCATVLAKDSGKDGCEKASNTDCGEELKRAGCATCTAVGPNGQTCLTCNGGQKVQLNGISCGDSCPSNSAANPDICECNEGFNLNSGKDGCEKASNTDCGEELKRAGCATCTAVGPNGQTCLTCNGGQKVQLNGISCGDSCPSNSAANPDICECNEGFNLNSGKDGCEKASNTDCGEELKRAGCATCTAVGPNGQTCLTCNGGQKVQLNGISCGDSCPSNSAANPDICECNEGFNLNSGKDGCEKASNTDCGEELKRAGCATCTAVGPNGQTCLTCNGGQKVQLNGISCGDSCPSNSAANPDICECNEGFNLNSGKDGCEKASNTQCNTPNCKICDNPKTDNEVCTECNDGDYLTPTNQCVPDCTTISGYYGDNDKKCKACSPECAECVGPANNQCSSCPAGKKLTYTDDSNPNNGGTCGDACKVSADGTGCETCGAQIGGTAYCSKCKTSTQAPLNGDCAASSRATFCTKMGNGVCTQCEDNYFLKDGGCYQTDRQPGKQVCSNAQGGNGKCQTCANGLAATDGNCAECHPTCATCSAPSTASSCKTCATGYYKENGDDTTDGPCMKCSEKISGCKQCVSSSGSSVICLESEVGTGGSTNKSGLSTGAIAGISVAVIVVVGGLVGFLCWWFLCRGKA

SEQ ID NO: 486 - protein, 132 aa, Giardia intestinalis
PKCDTSCKTCANGEPNGCTSCEAKKALSYEGESNTGTCKSECKPGTNNCEKCELTVDGTAYCSKCKDANQFPQNGVCSAAAGKAITCTTKGTGVCDKCANGLLRMNGGCYETTKFPGRASVRKQHRLGIPAK

SEQ ID NO: 487 - protein, 713 aa, Giardia intestinalis
MFGRFLLAIVILQLARTACTQEADDGKCKTCGVTIGQDTWCSECNGANYAPVNGQCVDVNAEGPSKTLCPQHSAGKCTQCGGNSFMYKDGCYSSGEGLPGHSLCLSSDGDGVCTEAAPGYFAPVGAANTEQSVIACGDTTGVTIAAGGNTYKGIADCAECSAPDATAGAEAGKVATCTKCGVSKYLKDNVCVDKAQCNSGSTNKFVAVDDSENGNKCVSCSDNLNGGVANCDTCSYDEQSKKIKCTKCTDNNYLKTTSEGTSCVQKDQCKDGFFPKDDSSAGNKCLPCNDSTDGIANCATCALVSGRSGAALVTCSACTDGYKPSADKTTCEAVSNCKTPGCKACSNEGKENEVCTDCDGSTYLTPTSQCIDSCAKIGNYYGATEGAKKLCKECTAANCKTCDDQGQCQACNDGFYKNGDACSPCHESCKTCSAGTASDCTECPTGKALRYGDDGTKGTCGEGCTTGTGAGACKTCGLTIDGASYCSECATTTEYPQNGVCAPKASRATPTCNDSPIQNGVCGTCADNYFKMNGGCYETVKYPGKTVCISAPNGGTCQKAADGYKLDSGTLTVCSEGCKECASSTDCTTCLDGYVKSASACTKCDASCETCNGAATTCKACATGYYKTASGEGACTSCESDSNGVTGIKGCLNCAPPPNNKGSVLCYLIKDSGSTNKSGLSTGAIAGISVAVIVVVGGLIGFLCWWFLCRGKA

SEQ ID NO: 488 - protein, 687 aa, Giardia intestinalis
MLLTAFYVVLGSFAAPCQQDGDHIVTCQVNKCETVGLFEICTECKTGGVPVDGFCRPFGSIQAAAAGCTKADGTALDKTATTCGKCGDGYFLFMGGCYKTESQPGSEICTTASNGLCTACKVDSQYIFQNKATPSEKGSECILCWDTTDRNGVMGVANCATCTAPASSTGPATCTECMAGTYKKSDTECAACHSDCATCSGEANNQCTSCETGKYLKSNQCVEKNTCNTNHYPDDTSMTCVACTVLDANCATCSFDSATAKGKCLTCNSNKIPRTTLDGTSTCVENSYAGCQGADNELFMKEDQSACLLCGDTKEASNDKGVANCRTCTKNANDSPPTCTACLDGYFLERGSCTTTCADNCATCSEATTEDKCKICKAGFFLASPGEGKCISCSDTNNGGIDGCAECTKEPAGPLKCTKCKPNRKPAGTSDNYTCTEKTCEDPTVCGGTSGACDAIVIDANGKEHYYCSYCGETNKFPIDGLCTDNKGTNAGCTDHTCSYCAAGFFLYMGGCYKIDTVPGSYMCSKSTTAGVCDTPNANNRFFVVPKAISAEQSVLACGNPLGTIAGGNAYVGVEGCSQCTAPDARADGGMAVATCTACEDGKKPGKSGTGCVACPDANCKSCTMDDVCEECADGFSLDNGKCVSSGTNKSGLSTGAIAGISVAAIVVVGGLVGFLCWWFICRGKAQ

SEQ ID NO: 489 - protein, 667 aa, Giardia intestinalis
MLLAIFYFVISTLTAKCTTQTQTCEAEKCEMVGETEICTRCQTGKVPIDGKCVDATANANCKNASGDGDANQVCGKMSSVPGNTLCTTVSPDGVCSVAANEYFVPPNADATHDSVVSCSEETPIHLANNKQYIGVAGCATCSAPKAPGEDNTPKAATCTKCAAGFLHTPSEGLSSCEETCPEGYFGHTATAESKKTCKSCTGGSSEAPNVKGIGDCLKCMYNEASGNTLTCEKCSAQKKPSLDKTSCNDCTGQNCAFCSSSGGDCEGCDSGFILDGQNCVKSDCKTENCKACTNPKAANEVCTECISTHHLTPTSQCVQYCQALGNYYAGTNADNKKACKECTVANCKTCNDQGQCQTCNDGFYKNGDACSPCHESCKTCSAGTASDCTECPTGKALKYGNDGTKGTCGEGCTTGQGSGACKTCGLTIDGASYCSECDTQNEYPQNGICTSTTARTVATCKNSNVANGICSSCTNGFLRMNGGCYETTKFPGKSVCEGANADADTCKAPVPGYKVEAGKLVMCSKGCDTCSDATTCTKCGDGYTKIENSQTCTKCDSSCETCTGAATTCKVCATGYYKTALGESTCTSCENDSNGVIGVKGCLNCAPPSSSTGSVLCYLMKGENTGGSVNKSGLSTGAIAGISVAAVVVVAGLVGFLCWWFICRGKA

SEQ ID NO: 490 - protein, 596 aa, Giardia intestinalis; identical to SEQ ID NO: 476

SEQ ID NO: 491 - protein, 1609 aa, Giardia intestinalis
MHTWILTLLMCTCSNRHHYLHNSNHYLKGGALCRLAAKAGTAERILFSDVSDCPENCTSCTDPYICEVCDHGYTLTNRGRCVDLCIEGDSETNCAVGHCTVFDDTLCSKCAHEGDVPAAGVCNTGVTTCVKDSHGICISCESGHLLYRGGCYPSKSALAQSICATDNQIVVEGMLYCSLCNDENEAPINGHCTDEHSSYCDAESGQCINCVAGGYFLFNGGCYNADEHPGSAICAEVRDGECTECGSHYPVTDGVCTYCPVDHCLLCENESCTQCQQGYVLRSSGRCVKLCSEGNGLQSCAIGHCTAFEGTLCTKCAYEEDVPVAGICTSGLTTCQKNFSQICISCEGEHLLYSGGCYATTGSYGLQICSIENQIAIGGKVYCSKCNQKKEAPLNGECTEAAADHCDVRDGACTGCKTTGYFLFQGGCYTLASIPGNIICAEVSGTTCIKCRDGYGIHEGECSPCTIAHCLDCKSDVATCNACDPKYFFTGTACVACEGEHCAACRDNMCVDCTDKTECNACAIPNCVLCDPALTECLACQEAYEPGEDGFCTPLPASECPLSCLCADQDVPALCTSCKPGFIAAGVVSGDTCLSCALEVEHCGLCSYIPESDSIVCEECLDGYRMDDGLCEPCGNGCKSCPHRANKCAECFAETPYFNPALTECLSACPPNSVAATNKKCSCIHGYYSTLQGCEKCDESCDTCSGGEIDKCVTCRSGFFLASGSWKGQCIPCDLSSFSDGSVIGVEHCIDCRGVQENGDLIVVCKECDLGYTLKGEVCVLDDSGHEDCPSNCICTDVSPTCVSCQRGYFTLSTPSAENCVRCSSAISGCKTCTVEGSSLRRSTSKVTCTLCDDGKGLVEGTCHSCHVTCKTCNGDPELCSTCYNPAYKLSLRSDQCVPECPEFSEEQNGRCVCLLGYSISFNGLTCVKDSSACPSICTCAVGNICSGCADGYFTFDPSRTDAARCEPCSGDFCSSCGRVPNDATFFGHTFSPGRRYAYRRSLESVNICIECADKQGCSACSIEGCNRCSASEHTKCTECMPDYQLSQDKKSCIALVPICPLGCTCVPGTSTCNGCADGYFEVDPTDEASGRCMRCSIPTRYIPTRISGARRLERLLSIRRKRTDSISLQIVRDASWNGVAGCAMCTTPSSPGPAICTQCVQGKHLLVSGESTQCLDACPDGMGSINNVCFNCNDENCLRCDENLDSCVECRPGASPTLTPDTELVVCETVCPLGCVCEDAEDSSICTGCQSGYYEVSVLARFIMRLRKTDVHCKKCLANCMTCTDESTCLVCADGYILHQTDASCVEKCDQGYYNKQGQCAPCTGEHCTSCTNETTCTSCTDSSFLSNGECVTCSTSCKTCGGGTENDCLTCPTGTVHSTGTGLGSCLQECSATAAGNCAVCNAIIDGTRYCSKCTPGEAPINGRCEPVSAARNVMCITSGDGTCESCSGGLFLFNGGCYATSRYPGSAVCTSSSDGLCTNCADGFTNTNGICSNCVLGCSSCSSTAASACTSCTEGFFPAFSGSQGVCKRCDDTTITDGYQGVQGCRICIAPQQAGIALCLDSSEAGNKSSLSAGAITGIAIAVFAVIGCAVGVLVWFLCCRRSKAV

SEQ ID NO: 492 - protein, 1906 aa, Tetrahymena thermophila
MFQTQRIDSIKITLITRQISTNTEIQQQCGNSYDYYQQEYQLEELHQKNNIIFYPKLKQTRILNGYGGGGQWGGNGGGGNWGGNNQCPNGCNCQRWKECTSCQSGFYNDNQQSRGRRSQTYSCQQCDQSCQECQGGSKQDCTSCKQNLFLAQDGSCQTCNTAQGYYISDGKCLKCDNNCLTCQAQSTTCISCKSPQILNLSSQCVNCDQNNGYFVSPQNICNPCDASCLTCSGPNKTDCNSCKTNFILSNKQCITCDTTNGNYLNNGQCTKCDPSCKTCNGSNKNNCITCQLNTYLRTDNTCQACDVQNGYYLTSSSICKQCNSSCKKCNGDNSNNCLSCYPNNYLKNDGTCSDCTDSKYFKDQTQMKCLPCDPSCLTCSNSNSNSCLSCPSGKYLYPDNSCQDCQTSNGYYIDTKTNPSIPRCQKCFSTCQACVDAGQSSCTACKPSYLRMNPYSGTNFKCIQCNTSLGQYTTSSGGTQTDCFNCHSSCKTCTDGNNKSCTTCADGLYFVQSGMDKLCQSCQINGQQFVDSNFFCQNCSSQCLKCQGNANTCTDCQDGQYLKKLDNTCGSCGDGFYINGSFCLKCDSSCKTCNGDKQNNCLSCSGSLNLNSINQCVDQCPEGTFALSNVCQACDPSCATCSQAGKCSTCPDGQYIFNDALCQTCPSNYYGDNASKSCKPCDSSCLTCNGPSSSNCLSCPGDITLQSGTCTSQCPSKYIQKNNQCLQCDISCNSCFDVDEYSCISCSNSNYAFLQDKGGKKKCVDCSQQSYYFKQGNDCLPCHPTCLTCNRQNDPNKCLSCPIGKFFQKDDQSCSDCTKRGYYKSSSLCLKCPINCDKCSVQGSNLICDLCSNPYIRDQTLTQCVLCSGDISFYYSPDDKICKKCDSSCKTCIGGKDTDCQSCFNGMNLLISEKRCIVCGDGYFINSPGKCSACIQNCRQCNDQSTCQVCNTSNSQPIYLDENKQCVSSCDQNGGYFIQNDGVLKCLKCDTDCQQCQSKNLCKKCMNNTSLILQTNNVDVKCGVCNQNNYIDPQDQFCKKCDSSCLTCSGPLSTDCLTCDQSQNLYKQPDNSCSTCTGNFKIVGQNCVQCDPKCNGCDSTGCKSCASGFYFVEGSKQCNTCDIQNGKFIQNSLTCISCNSKCKTCSGPSESDCILCNGQLTRDINNQCVVCNVDNGFYIDSINQRCLPCAQNCKKCTGPSIGECTQCAKDLYLSNDNAGNQVCQECNIQNGYFISINKCLKCDSSCKTCNGTSSSECLTCFTGYFIIGSNKSCVQCPTEDQNNIIRGSIRSGNYVLLQKCNKCKQDYILQEDPNACISGCNDIGENLVFNTVTKQCECQSQMYYYNIPNKANQQIQSIFCSQQPIDGYFCNQNKKCYQCNSNCKVCQSRFSCSQCESQYYLWQGQCIQKCEDSQGLIVNSDNSLTPSNLCICKQGYVLREQDKICVLKLQIISLKLTIQNDNNLLTITLNRAPFNDESQDLKLLIDPQTMKLSQDYFIKSMSIIDNKIYYEIQVTQNRKINTIQVTLNKQINTLSLSNTILTTEEFNKSNQSSQQRNQNINDASQILVPDSGSAQKVLGPIAMFKDNIPQSIYTYSLLGDSFIFEAIPSFQEVNCQISSESTTNQSNNDNQSEQYDSDQLKILTQFGLQKFLYSNFLFPHLSLVLCTVLVFLNLFARAIMKGKQYTMQIVNILLNVMSNLNQGYITPTIFSIYFSLQFSESRGLAVFQAFIHLFFFIEITYILFKKDNEYIENHIPNFLVNINFKAKGMFQEFSVGITFVMISITSKKYTEIMGSTTISNEDLSSIEKQSVIILFMLLACLGISLILFLIRLFISLLQVFRQIKAFFKKRSNSSLLSLQNEQMLQEIFQTNQKNKFPTIKYIKQQKYVELQHTKQVNLVSFQDTHN

SEQ ID NO: 493 - protein, 718 aa, Tetrahymena thermophila
MDYLVCQQNNSYVNQQNQQCSPCSSNCTQCDNFTKCNTCASGYYFSTTLEFQCVKCSDPCKECTSSTICTACYSQYYLNGNTCTNCQSPCLTCTSASECQTCQDGYYISGSQCMRCVSPCLKCSSSSSCSSCSFGYFLSGTTCQQCDSICTSCTSNTNCQSCSDGYFLNNNQCNQCDPTCTKCTSSSSCSSCQSEYFLDANNKCSKCQLNCIQCQNLQSCQKCQEGYFLDNQNCQKCTNNCQTCSSSTYCLSCLSGYYLQGNSCILCNDKCTQCTSSQICTSCKDGYFLNQGQCQKCDSSCSKCTSLSYCSACSDGYFLNQGNLCQQCQPNCTQCQDSQTCSQCQSGYFFDTLSRKCTKCINNCQTCSSSTLCITCLQGYLLSSKSSCFKCIEFCSTCNENLICPSCFDGYFLDKNSCQKCLQNCAQCNDSQTCTQCLKGYNLYDNLCLTSEQCPSGCKLCQDNFSCQTCLDGYVKQNQQCIKCSVENCSFCDQQQRCFQCKSGYKLLNNSQICVKDCGVGHYLSDNNECLACDQTCFTCKGPTDTDCIICKSNLYLSVSSLKCTSCQDQQYLDNQNNCQSCFSICETCYGPSSNQCIICKNQLVKSKISFECITLDQYQSEELQYYFKNGFECSEIQNKNLTQKCEEQLEFSKFTCWIDVIFMFSYFCQFVKIIQHLLHLDIANIRIQCLFLKTDSLMSLILQQSLKFYIIQTIKAR

SEQ ID NO: 494 - protein, 134 aa, Giardia intestinalis
  misc_feature (127)..(127): Xaa can be any naturally occurring amino acid
IDGASYCSECAVDTEYPQNGVCAPKANRATPTCSDSPIQNGVCGTCANNYFKMNGGCYEIAKYPGKAVCTATQAGGTCKTAADGYKLDSGTLTVCSEGCKECASGTECTTCMDRYVKSTRICTKCDXSCETCNG

SEQ ID NO: 495 - protein, 137 aa, Giardia intestinalis
  misc_feature (44)..(44): Xaa can be any naturally occurring amino acid
IDGASYCSECAVNTEYPQNGVCASATARAAATCKTGNVAKGACXSCTNGFLRMNGGCYETTKFPGKSVCTTTPGTDTCTSMASGYYIDGSNNLVVCSDGCADCTTPSTCTTCKDGYTKIGSGQTCTKCDPSCETCSG

SEQ ID NO: 496 - protein, 218 aa, Giardia intestinalis
MFGRFLLAIVILQLARAACAQEADDGKCKTCGVTIGQDTWCSECNGANYAPVNGVCEDVETQAYKKALCKAHASGACTTCGGNSFMYKDGCYSSGEGLPGHSLCLSSDGDGVCTEAAPGYFAPVGAANTEQSVIACGDTTGVAIAAGGNTYKGVADCASCAPPSNNQGPVLCYLMNGDSPGGSTNKSGLSTGAIAGISVAVIVVVAGLVGVLCWWFLC

SEQ ID NO: 497 - protein, 594 aa, Giardia intestinalis
MLVGIGLIFAVALTEVCSPSIDGCAECDSTGQGCTKCDANGNTPYLKKTNPSDPTGTCVSAVDCQGSAGYYTDDSVSDAKECKKCNAPCTACAGTADKCTKCDANGAAPYLKKTNPSDPTGTCVSAVDCQGSAGYYTDDSVSDAKECKKCAEGQKPNTAGTQCFSCSDANCERCDQNDVCARCSTGAPPENGKCPAATPGCHSSCDGCTENAMTNQADKCTGCKEGRYLKPESAAGQSGTCLTAEECTSDTTHFTKEKAGDSKGMCLPCSDATHGIAGCKKCALKTLSGEAESTVVCSECTDKWLTPSGNACLDNCPAGTYPNDNNLCTSCHDTCAECNGNADRASCTACYPGYSLLYGSCTAGTCVKECTGAFGANCADGQCTADVGGAKYCAQCKDGYAPIDGICTAVAAAGRTNVCTAADGTCTKCAGEYTLMSGGCYGVAKLPGKSVCTLASNGKCIMCAANGQAPVQEKCPECSEGCAKCNDSNACTECLPGYYKGAGDKCFKCTASSGNNNQITGVANCVTCAPPAGGSGSVTCYVKTDGTSGGDDNTGGSVNKSGLSTGAIAGIAVAVVVVVGGLVGLCCVICRGKA

SEQ ID NO: 498 - protein, 769 aa, Giardia intestinalis
MRSRFRWSLCSTEFRDMKQGSVRLLMQTRAVLCQLLASMLVGIGLIFAVALADACSPSIDGCAECDSTGQGCTKCDANGNTPYLKKTNPGDQTGTCVSKEDCTRTSYYATPTDPNAKECKKCDATCAACSSGLATACTKCEAGGATPYLKKTNPGDQTGTCVSKEDCTRDGGYYADDTTDPNAKECKKCDATCAACSSGLATACTKCEAGGATPYLKKTNPGDQTGTCVSKEDCTRDGGYYADDTTDPNAKECKKCDATCAACSSGLATACTKCEAGGATPYLKKTNPGDQTGTCVSKEDCTRDGGYYADDTTDPNAKECKKCDAGQKPNTAGTQCFACPDSNCERCDQSDVCARCSTGAPPENGKCPAATPGCHSSCKDCVTGANTSEDDKCLSCSGDNYLKVTDTDAHSGVCVSASACTSDTTHFTKEVADSTGSKKMCLSCSDATHGITGCKKCALKTLSGETESTVVCSECTDKRLTPSGNACLEQCPAGTYADNINGVSVCASCHATCAECNGNADAASCTACYPGYSLLYGSGTAGTCVKECTGAFITNCADGQCTANVGGAKYCAQCKDGYAPIDGICTAVKTGRDASVCTAAGGKCTKCAGEYTLMSGGCYGVAKLPGKAVCTTANNGKCTMCAANNRAPVQEKCPECSEGCAKCNDSNACTECLPGYYKGAGDKCFKCTASSGNNNQITGVANCVTCAPPAGNAGGPLTCYIKTDGDNTGGSVNKSGLSTGAIAGISVAVIVVVELVDFLCWWFVCRGKA

SEQ ID NO: 499 - protein, 1274 aa, Giardia intestinalis
MLVGFLLVCATVLAKDSGKDTCFPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNTPNCKTCDNPKTDNEICTKCNDGDYLTPTNQCVPDCTAISGYYGDTDKKCKACNPECAECVGPANNQCTACPVGKMLQYTDTNTPVNGGTCMDQCSVSSTNDGCAECGAQIGGTAYCSKCKNTQQAPLNGNCAASSRVAFCATITSGACTKCNEGYFLKDGGCYQTDRQPGKQVCSNAQGGNGKCQTCANGLAASDGNCAECHSTCATCSTADAADKCKTCATGYYKENGDDTTAGLCKKCSEKISGCKQCVSSSGSSVICLESEVGTGGSVNKSGLSTGAIAGISVAVIVIVGGLVGFLCWWFLCRGKA

SEQ ID NO: 500 - protein, 134 aa, Giardia intestinalis
IDGASYCSECDTQNEHPQNGVCAATNRRTMTCNNLGSGVCNTCANGLLRMNGGCYETTKFPGKSVCEGANADADTCKTPTPGYKVEAGKLVTCSKGCDTCSDATICTKCGDGYTKIGSSQTCTKCDASCETCNG

SEQ ID NO: 501 - protein, 137 aa, Giardia intestinalis
IDGASYCSECATTTEYPQNGICTSTTARTAATCKNSNVANGICSLCTNGFLRMNGGCYETTKFPRKSVCTTTPDADTCTSVTSGYYIDGSSNLVVCSDGCAECTTSSACTTCKDGYTKIGSSQTCTKCDSSCETCTG

SEQ ID NO: 502 - protein, 134 aa, Giardia intestinalis
IDGASYCSECATATEYPQNGVCAPKASRATPTCNDSPIQNGVCGTCANSYFKMNGGCYETVKYPGKTVCISAPNGGTCQKAADGYKLDSGTLTVCSEGCKECTSSTDCTTCLDGYVKSASACTKCDFSCETCNG

SEQ ID NO: 503 - protein, 370 aa, Giardia intestinalis
MLLPALCFLMSGLAAQRTKQPTSGCQVDNCERCVPSDETKCEACNSGFDLDENTKQCNPAPAECPIVNCQTCSQDKQTCVACEPGKHLTPTKKACLDACPVGTYLSGQTCAPATPPVRSAAGPALSKCTACLAGKMLRYTDETKLNEGGQCVEQCVEGPECETCGLTIGGTKYCSKCKGSNVPLNGVCTSNAARTQFCTTAADGRCSACAAGYFIQEGGCYQTTRLPGKSICTTDNGGKCQTCANGQTPDGGTGVCPLCDSTCKTCTAGQTQQCQTCFSGYYKSGTKCVKCDASDGQITGVTDCVSCAPPSGDSGSVTCYVKMDGSSGGNSTNKSGLSTGAIAGIAVAAVIVVGGLVGFLCWWFICRGKA

SEQ ID NO: 504 - protein, 557 aa, Giardia intestinalis
MFLLINCLIASTLAGACSTTQANCVAEKCEMVGETEICTQCKQNYVPINGVCEAAASSNTKCQKASADEASDQTCGKCLSTTFMYKGGCYDKTGNLGRIICKTEGSDAGKCGACNDEKGFFDNPDAANNVDSCISCGDATGVTIPGSSTKTYKGVAGCAKCTKPSQISENTGTKEATCTECNANLYLKAVSSPTSATSCVSAEDCKTGYFPTTDTTDSKKKCLTCSTADKGGIDGCSACELLPSTTRASTVLISCSACSTNNLSPLKNECMQDCPAGTYADSNVCKPCHTSCASCKGDNTESSCTACYPGSVLSYGTDNTKGTCIAECTGKYLENCADGQCTATIAGSKYCSKCKSGFVPVNGLCVSAETARAAPPGSTPDKTNGVCTACTEKYFLESGGCYQAEKFPGNTLCTTADAGKCTTCANGQDKDSNGSCPACPTNCASCAKDNTKTCNKCFSGYYLDTAKACKKCSETSGNIQGVENCISCLAPTSPQSSTPVTCYVKTSGGGSGDNSTGGDSGPNLSSGAIAGISVAVIVVVGGLVGFLCWWFVCRGKA

SEQ ID NO: 505 - protein, 374 aa, Giardia intestinalis
TRCMPGYFLKDGPPKTCVLCDDETSGIPGCAECTGGVGSLKCTECKPNYRPSGEPSDLTCTKTCEDETACGGTAGACDAIVVGNDGSMLSYCSKCVGAGYGPINGKCTNALAGNTCADGVCTRCTNNYFLYMGGCYDVSKAPGNLMCSAAPSGFCTTPVGRYFKIPGDSAAQQSVLACGNPVGATAGDKAYVGVLDCTACAAPQAPAANAMAAAVCSACDKTKKPNKDGSGCTLCAVGGCKSCAIDGMCEVCAEDNKKPNMAGSTCYVCPAQGCSHCSADNKCEACTNKDQRPSLDGTQCIVCDIERCMRCSAEGVCGECEEGYVPRDGMCVSSGTNRSGLSTGAVAGISVAVVVVVGGLVGFLCWWFVCRGKA

SEQ ID NO: 506 - protein, 373 aa, Giardia muris
PSCAGCKTCDSASGAEVCLSCTTAGNKVQPNGKSCATGCPANSSSNGDICECDSGYTPSQSENKCEKISCSTPSCEVCSNPGKDNEVCTQCATDNYLTPTNQCVGGCAVISGYYGNKTTNKCEKCHPDCVECVGSANNQCSACPAGRALKYTNDSDTAKGGTCGEACTVSTGNNGCETCGAQIGGTAYCSKCGNAQQAPLNGNCSANAHSRFCKTMGTGVCTECMDGFFIKDGGCYKTDRQPGKQVCSDATGGNGQCKKCASGIATSDGNCADKQCHSSCATCTTANDANACETCAAGYYKENGNTAGPCKSCSEGLAGCKQCTMSTTGNTFLCLEMGSTGGSTNKSSLSGGAIAGIVIAVIVVVGGLVGFLC

SEQ ID NO: 507 - protein, 235 aa, Giardia muris
PFARAATRFVLNTASKTCIPECTGAFAANLRNWAVHGRRRGSKYCSKCKAGYAPEDGICVSETTRSMPSGCTPNDGVCTACTGDYFLLSGGCYNTKTYPGISVCTAVASGKDGQCDTCANGQTPVNGVCPSCPEGCEKCTGSNDPKTCSACLPGYYKSGDNCVKCDSNSTSGSDTITGVSGCVSCALPSGSSAVTCYVTGSSTGGSTNKSSLSGGAIAGIVIAVIVVVGGLVGRA

SEQ ID NO: 508 - protein, 347 aa, Giardia muris
  misc_feature (129)..(129): Xaa can be any naturally occurring amino acid
  misc_feature (170)..(170): Xaa can be any naturally occurring amino acid
FNTGDKTCTNKCDATCKTCSAATDANRCLTCMPGYFPIDSTDQQGKKCVPCDSVDDKGREGCSVCSNTGGFKCTECKVNYKKQSNGDAGDDYTCVKICEDETACGGTSGACDAIVIDANGKELHYCSYXGEANTYPIDGKCNSAKANNQCDQGVCTQCTNNYFLYMGGCXKYDTVPGSLMCTEATTAGVCTTPNANNRYFLVPGASNTDQSVLACGNPLGTLVGTGNTAKAYVGVDGCSQCTAPTALTTVGMTPAVCTSCDNSKKPNRDGSGCVVCSDTNCKSCVMDGVCGECVDGYNLEGDKCVSSGANRSGLSTGAIAGISVAVIVVIGGLVGFLCWWFICRGKA

SEQ ID NO: 509 - protein, 235 aa, Giardia muris
GSVLSYGSDNTKGTCIAECTGKYLENCADGQCTASIAGSKYCSKCKSGFVPVNGLCVSAETARAAPPGCTPDKTNGVCTACTEKYFLESGGCYQAEKFPGNTLCTTADAGKCTTCANGQDKDSNGSCPACPTNCASCAKDNTKTCNKCFSGYYLDTAKACKKCSETSGNIQGVENCISCLAPTSPQSSTPVTCYVKTSGGGSGDNSTGGDSGPNLSSGAIAGISVAVIVVVGGLV

SEQ ID NO: 510 - protein, 255 aa, Giardia muris
GAGADKCTACPAGRALQYSGTDIAQGGSCVDECKVGTGQGGCETCGAQIGGTKYCSKCSTPEEVPVNGVCQANNVRASVCKTPNNAGGCTTCENGYFLKDGGCYETDRQPGKQVCKTADSNRKCTACANGQTADGSGVCPSCPEGCEKCASGTPQKCSACLLGYYLSTDKCVKCDTDSTSGSDTITGVSGCVSCKEPTTPPGTVTCYATSSSTGGSTNKSALSGGAIAGIVIAVIVVVGGLVGFLCWWFVCRGKA

SEQ ID NO: 511 - protein, 235 aa, Giardia muris
LPFARAVPGYSLLYSPDGLAGTCIPECTGAFAANCETGQCTAVVGGSKYCSKCNKGYVPVDGVCVSATKRAQPTGCTPGDGVCTACTGDYFLLSGGCYNTKTLPGKAVCTGVAASSNGKCDTCANGLKADSSGVCPSCPEGCEKCATSGNTQTCSACLPGYYLSNNNCVKCDVNDGQITGISGCVSCAPPSNSPGTVTCYLAKSGSTNKSSLSGGAIAGIVIAVIVVVGGLRRKG

SEQ ID NO: 512 - protein, 273 aa, Tetraodon nigroviridis
MSAGFFADGHVCAACHSSCATCFSRLGCQSCGSRQPLLGPDGSQCLASCPPGSYQADHTHCRRCHESCTECHGPGQRECASCSDPTALLRGGECVGECGTGFYSQAGVCYDCHPSCRSCVGPLASDCLQCLKPEEVVLPQSGQLQHGVCTAGCPAHKHLDDTQTCRAPRGCLSRVSPLLLALHRPVCRQLHVLSPAIQPERRPLPPRLPAGFFVQDGQCQACHPSCLTCSGPSQADCVSCPSLASLQDGYCRTSCPDGLFLHAASGECLGKCT

SEQ ID NO: 513 - protein, 230 aa, Giardia intestinalis
IDGASYCSECATATEYPQNGVCSSTTVRAAATCKAGSVAKGMCNSCTNGFLRMNGGCYETTKFPGKNVCEEAAPAGDTCQTPADGYKLNNGALITCSAGCKTCTSQDQCDTCKAGYAKTGGNTKKCVPCATGCSECNADDATKCTVCAAGYYLSKEKCIACDKSDGGSITGVANCANCAPPTNNKGPVLCYLIQNTNRSGLSTGAIAGISVAVVAVVGGLVGFLCWWFLC

SEQ ID NO: 514 - protein, 677 aa, Giardia intestinalis
LMAACQPDGDHAATCQTGKCETVGSAEICTECKTGGVPVDGFCRPFGSPQAAAAGCTKAGGAALDKMTATCEKCGDGYFLFMGGCYKTTDGPGSEICTKAEGGLCTECKTANGLFKNPAATPEKGSECILCSDINGADGYTGVANCAQCTKSDSNKGAATCTACQAGYYKDFQACSKCDGTCLTCETSAAQCTSCPEGKYLKGDKSCVNNNGCTGNTYADPESGKCLPCNTIDQACTQCEVDSTTKKPKCTNCGGQKMVKTAIDGTTTCVDANGCATSNVDGSHFLNDGSTKCILCSDDSESLEANKGTPGCKTCKKNGAKPTCSECLDGYYNSGNGGTVTCEACGANCATCTQAGNDKCTKCKPGFFMKGNGPTGECVACDNAQGGIDGCAECTKESTGPLKCTKCKPNRKPAGTSDNYTCTEKTCENPTACGGTAGSCDAIVIDDQGTTKHYCSYCGDSSQAPIDGLCASEAQKAGNTCANGVCTQCTNNYFLYMGGCYSTQKAPGSFMCKTAGNTGICTEAANNRYFVVPGASNTDQSVLACSNPLGTLTGTGDTAKAYVGVEGCSQCTAPAALSDGGMAPAVCTSCDSSKKPNRDGSGCVLCSVGGCKSCVMDNICGECNSGFSLDNGKCVSSGANRSGLSAGAIAGISVAVVAVVGGLVAFLCWWFVCRGKA

SEQ ID NO: 515 - protein, 419 aa, Giardia intestinalis; identical to SEQ ID NO: 473

SEQ ID NO: 516 - protein, 673 aa, Giardia intestinalis; identical to SEQ ID NO: 472

SEQ ID NO: 517 - protein, 547 aa, Giardia intestinalis; identical to SEQ ID NO: 471

SEQ ID NO: 518 - protein, 547 aa, Giardia intestinalis
MFYAFLLTGLALELVRAAQAGDECEEVASSEPNTCKACSAVVNGKKYCSQCNGGGSQSAPTDGVCSADNNECTRKQDGKCTQCANKSFMYKGGCYKDSQAPGNTMCETANAGVCTQAKEGYFLPPGTDNAHDSVVSCGDTTGVTLTGDKKYTGVAECVTCTQPGQLSIGGTKAAICTKCAADLYLKIDRGVMECVAESGCGEGFFPTIVDGVKKCAGCSEAGSGGIEDCELCIPRAPAPEAGVKVTCSKCHASKKVSPLKDECMDNCPAGTYDKQNVCTPCHSSCASCQTDDKETSCTACYPGHSLLYEANGATGRCVKECTGAFITNCADGQCTADVGGAKYCAQCKEGYAPIDGVCTAVKIGRDASVCTAASGKCTACTGAYALISGGCYGVAKLPGKAVCTAANNGECTTCANGQQPSGKVCPTCPAGCSKCTGSAPSQQCSECFPGYYKSGTKCVACDKDDGSIKGVPNCLSCKEPASSSGAVTCYLTQQKTDDGTGGDTGGDSMNKSGLSTGAIAGISVAAIVVVGGLVGFLCWWFICRGKA

SEQ ID NO: 519 - protein, 742 aa, Giardia intestinalis
MFCRFVLAGVILQFVWTAQIAEKAGTATCADQTTNCADEACNVLIDGKLYCSQCKADPADRAPVNGVCTDVSSDTAVCKTHAGGKCTGCNGNSFMYKGGCYERAKPPGNAMCQAADAGKCTEAVAGNKYFVPPADTDDAHDSVVSCGDATGVTLTGDKIYTGVAGCATCEKPEQLSASGTKAATCTACQEGKYLKTATDSATSCVTEEECTGTEGFFVKNGGTKTCEACDPGCKTCKTEAAKCTSCKDDKPYLKKDNGSDTGTCVTETECKNQSTHYADDTEPKTCKACAEGTSNGCATCEKGADGAVACKTCENQKKVQPNKKGCVESCPLNSNEEKTSGVCECVEGYVPEEAGTGCMKKSDPPAAPCNTPGCKTCSEPKTSKEVCTECEGTKALTPTGQCIDACGDLGGYYAGTNEGGKKACKKCEVENCLLCNGQGQCETCKDGYYKKETACAKCDTSCKTCANGNSNGCTSCEPKKALSYEGEGNTGTCKSECKPGTNNCEKCELTVDGTAYCSKCKEANQFPAEPESARRAAGKAITCTTQGTGVCDKCANGLLRMNGGCYETTKFPGKSVCEEAASAGDTCQVEAPGYHLNNNDLVTCSAGCKTCTSNTVCTECMDGYAKTDNKCTKCATGCATCAGSASNCDTCSTGYYKYKNACVSCTESNSDKTITGVANCANCAPPLNNKGSVLCYLVQSGENTNKSGLSAGAIAGIAVAVIIVVGGLVGFLCWWFMCRGKA

SEQ ID NO: 520 - protein, 547 aa, Giardia intestinalis
MFYAFLLTGLALELVRAAQAGDECEEVASSEPNTCKACSAVVNGKKYCSQCNGGGSQSAPTDGVCSADNNECTRKQDGKCTQCANKSFMYKGGCYKDSQAPGNTMCETANAGVCTQAKEGYFLPPGTDNAHDSVVSCGDTTGVTLTGDKKYTGVAECVTCTQPGQLSIGGTKAAICTKCAADLYLKIDRGVMECVAESGCGEGFFPTIVDGVKKCAGCSEAGSGGIEDCELCIPRAPAPEAGVKVTCSKCHASKKVSPLKDECMDNCPAGTYDKQNVFTPCHLSCASCQTDDKETSCTACYPGHSLLYEANGATGRCVKECTGAFITNCADGQCTADVGGAKYCAQCKEGYAPIDGVCTAVKIGRDASVCTAASGKCTACTGAYALISGGCYGVAKLPGKAVCTAANNGECTTCANGQQPSGKVCPTCPAGCSKCTGSAPSQQCSECFPGYYKSGTKCVDVDKDDGSIKGVPNCLSCKEPASSSGAVTCYLTQQKTDDGTGGDTGGDSMNKSGLSTGAIAGISVAVIVVVGGLVGFLCWWFICRGKA

SEQ ID NO: 521 - protein, 615 aa, Giardia intestinalis; identical to SEQ ID NO: 467

SEQ ID NO: 522 - protein, 721 aa, Giardia intestinalis
MLLGLLLFCTVARANCKAGNTPSANGQTCVPNADQCEDPLTTAGCATCTGTGSAQTCLTCSSSKKVRPDKKGCIASCPPSVTTENSGVCECTPGNKPSSDGTTCVPNADQCEDPLTTAGCATCTGTGSAQTCLTCSSSKKVRPDKKGCIASCPPSVTTENSGVCECTPGNKPSSDGTTCVPNADQCEDPLTTAGCATCTGTGSAQTCLTCSSSKKVRPDKKGCIASCPPSVTTENSGVCECTPGNKPSSDGTTCVPNADQCEDPLTTAGCATCTGTGSAQTCLTCSSSKKVRPDKKGCIASCPPSVTTENSGVCECTPGNKPSSDGTTCVPNADQCEDPLTTAGCATCTGTGSAQTCLTCSSSKKVRPDKKGCIASCPPSVTTENSGVCECTPGNKPSSDGTTCVSETACNTPNCKTCDNPKTDNEICTECNDGDYLTPTKQCTQSCGAIGSYYDGDKACEPCDPSCAGCTTKGPAKCTLCPPGKRLQYTNDDPNQGGSCVDECKAEVDGCAECGAVIGGTKYCSKCKEDKWAPQNGVCANSVTRNSFCTNAAGGVCTQCAADHFLQDGGCYKLGRQPGIQICTLADSNGGCQTCANSLQPNDGACPSCHSTCKTCSTADSSDKCTSCAAGYYMVGSGPNTCISCDSNSGSVKGVAGCMSCAPPPNNQGSVVCYLINDSGSTNKSSGLSTGAIAGISVAVVVVVGGLVGFLCWWFLCRGKA

SEQ ID NO: 523 - protein, 894 aa, Giardia intestinalis
MCPRFRWPLCSIEFRDMKQDPVRLLMQTRAVLCQLLASMLVGIGLIFAVALADACSPSIDGCAECDSTGKKCTKCDANGNTPYLKKTNPSDPTGTCVSAVDCQGSAGYYTDDSVSDAKECKKCNAPCTACAGTADKCTKCDANGAAPYLKKTNPSDPTGTCVSAVDCQGSAGYYTDDSVSDAKECKKCNAPCTACAGTADKCTKCDANGAAPYLKKTNPSDPTGTCVSAVDCQGSAGYYTDDSVSDAKECKKCNAPCTACAGTADKCTKCDANGAAPYLKKTNPSDPTGTCVSAVDCQGSAGYYTDDSVSDAKECKKCNAPCTACAGTADKCTKCDANGAAPYLKKTNPSDPTGTCVSAVDCQGSAGYYTDDSVSDAKECKKCNAPCTACAGTADKCTKCDANGAAPYLKKTNPSDPTGTCVSAVDCQGSAGYYTDDSVSDAKECKKCAEGQKPNTAGTQCFSCSDANCERCDQNDVCARCSTGAPPENGKCPAATPGCHSSCDGCTENAMTNQADKCTGCKEGRYLKPESAAGQSGACLTAEECTSDKTHFTREKAGDSKGMCLSCSDATHGITGCKKCALKTLSGEAESTVVCSECTDKRLTPSGNACLDNCPAGTYADNINGVSVCASCHATCAECNGDANAASCTACYPGYSLLYGSGTAGTCVKECTGAFITNCADGQCTANVGGAKYCAQCKDGYAPIDGICTTVAAAGRDASVCTAADGKCTKCAGEYTLMSGGCYGVAKLPGKSVCTLASNGKCTMCAANNQAPVQEKCPECSEGCAKCNDSNACTECLPGYYKGAGDKCFKCTASSGNNNQITGVANCVSCAPPAGGNGGPVTCYIKTDGDNTGGSVNKSGLSTGAIAGISVAVVVVVGGLVGFLCWWFICRGKA

SEQ ID NO: 524 - protein, 593 aa, Giardia intestinalis; identical to SEQ ID NO: 474

SEQ ID NO: 525 - protein, 520 aa, Giardia intestinalis
MLLPALCFLMSGLAAQRTKQPAPSCQVDNCEQCNADNVHCDQCAAGFDPNTDKTQCVRACQVDNCEQCNADNVHCDQCAAGFDPNTDKTQCVRACQVDNCEQCNADNVHCDQCAAGFDPNTDKTQCVRACQVDNCEQCNADNVHCDQCAAGFDPNTDKTQCVRACQVDNCEQCNADNVHCDQCAAGFDPNTDKTQCVRACQVDNCEQCNADNVHCDQCAAGFDPNTDKTQCVRACQVDNCEQCNADNVHCDQCAAGFDPNTDKTQCVRACQVDNCEQCNADNVHCDQCAAGFDPNTDKTQCVRACQVDNCEQCNADKIHCDQCAAGFDPNTDKTQCVRACQVDNCEQCNADNVHCDQCAAGFDPNTDKTQCVRACQVDNCEQCNADNVHCDQCAAGFDPNTDKTQCVRACQVDNCEQCNADNVHCDQCAAGFDPNTDKTQCVRACQVDNCEQCNADNVHCDQCAAGFDPNTDKTQCISSSINKSSGLSTGAIAGISVAVVVVVGGLVGFLCWWFLCRGKA

SEQ ID NO: 526 - protein, 633 aa, Giardia intestinalis
MFEKIIFGIAILQVVWAATTCTEASSDPQTGQCATGKCDVWIGGSNFCSQCSTAAEYLINGLCYPDNKDNGCEGQPSTGVCTQCAQGFFLHRGGCYKIGTEPGNLICEDTQASQTQGVCEACSSGYFKNPAADAAGTPPCIACNDTVGNSNNVGIANCKTCASPSAAGTENAPQTATCTACVDGFSPDSTGKACVAVQCAENCLTCTSSGEDKCKSCKDGYFLGAASGGEGKCIKCNDTTGANSYKGIANCAKCTQPQSAGPAVCTECAADLYLKIDRGVMECVAAAGCGEGFFPTTVGGVKKCIGCSEAGNGGIDKCAKCTLKTPAPEAGVKVTCSECDSEKKLSPLKDECMDSCPAGTYDKQNVCTPCHSSCASCTDATSTTCTACYPGFVLNAASGASAGTCIPECTGQYAENCADGQCTAIVGGSKYCSKCKAGYVPVDGVCVSTTTRAVTGCTPGDGVCTACTGSYFLQSGGCYQSTTYPGNTLCSSATNGKCQTCANGQTADNQGSCPACPDGCSKCTGSASPQQCQTCLPGYYKSGDSCVKCDASANGIVGVPNCISCAPPAGGSGSVTCYVKTDGTSGGDDNTGGSANRSGLSTGAIAGISVAVIVVVAGLVGFLCWWFICRGKA

SEQ ID NO: 527 - protein, 705 aa, Giardia intestinalis; identical to SEQ ID NO: 468

SEQ ID NO: 528 - protein, 539 aa, Giardia intestinalis
MGVAGCSECSHTGTSGPATCTECQAGFVTKDSACVKCGDGCSACSADTPTQCTACVEGKFLKDGNTCVEATECGADKYADKKTWTCKACDPDIAGCTACEYNDATGKPRCTNCGTNKTPRTTLDGTSTCVTKDYAGCQGADNGLFMTEDNVCRLCSDPAASDSEPKNKGIAGCKTCTKQQSQKPECIECLEGYIKEGNGPAATCEACGANCATCSEKADKTKCQTCKTGFFLKVSSTPGECFACDDTNNGGIEGCSQCTMEASTFKCTDCKVNYRKQSGTSPVTCTKVCEDDTACGGTSGACDAMIIDDQGTTKHYCSYCGDSSKYPIDGLCASEAQSNTCNNHVCESCTTGYFLYMGGCYSTQSPPGQHMCKTAANGVCTAVNENNKYFLVPGASNAQQSVLACSNPLGTLVDPQGTAKAYVGVHGCSQCTAPAALTTVGMAAAVCTACDSGKVPNKDGSGCVTCSVGDCKSCVVDDVCEECNSGFSLDSSGASCVSSGANRSGLSTGAIAGISVAVVAVVGGLVGFLCWWFVCRGKA

SEQ ID NO: 529 - protein, 390 aa, Giardia intestinalis
MTEDNVCRLCSDPAASDSEQKNKGIAGCKACTKTASANPACTECLEGYIENRSGGFTCDPCAPGCATCSKKEDPSKCLTCKQGYFLKDSSSGECISCSDTTKGGIEGCAECTNSGTFKCTKCKVNYRPSGEPSTGVTCTKACEDDTACGGTAGACDAIVIDNDGVEHHYCSYCGDSSKYPIDGLCASEAQSNTCNNHVCESCTTGYFMYMNGCYKVNTEPGSLMCKTSSKEGVCTEAANNRYFLVPGATNAQQSVLACSNPLGTSTGTDSAAKAYVGIDGCSACTAPAGLSDGGMTPAVCTSCDSDKKPNKDGSGCVVCSDTNCKSCVMDGVCGECNSGFSLDNGKCVSSGANRSGLSTGAIAGISVAVVAVVGGLVGFLCWWFVCRGKA

SEQ ID NO: 530 - protein, 694 aa, Giardia intestinalis
INMFDKLIFASLALQLTWATQVKRMVRSATCDSTTSGSTKCAAEKCNVWIGGKDYCSQCSTDAELLIDGGCAPTTSDLAKKCISDNKGKCSSCGDGYFLHKGGCYKFGTAPGNAVCTEPSAPGDSLPAGVCTTCGSGYFKNPAESAASTPPCIACNDTAGNSGNTGLVGCGTCDPPVSGQATCTSCLDGFFGIGEGTVTCTECTGECKTCKGGADQCTSCKTSSKYLKITDSVAETGECIDQGQCTETHFAMVDGGINMCYLCNTTDKGGKVGCRTCTKSGTVTCKTCLDGFFGTTDCVACHEDCLTCKIEAAKCTSCKADTKPYFKEGADNDQTGTCVDEVECKGDHFSTIDTSNSDKKICVPCSKTDKGGITNCKTCAFKVSSTEERPAITCTECTTNNLSPLKDECMAACPAGTYANNKVCASCHSSCAGCQTDDRETSCTACYPGYSLLYEPNGATGRCVKECTGAFITNCADGQCTADVGGAKYCAQCKDGYAPIDGICTTMAAAGRDASVCTAAGGKCTACTGDYALVSGGCYGIQKLPGKAICIAANNGECTTCANGQQPSGKVCPTCPAGCSKCTGSAPSQQCSECFPGYYKSGDKCVKCDKDSENIKGVPNCVSCKEPANSSGAVTCYLTQQKTDDGTGGDTGGDSMNKSGLSTGAIAGISVAVIVVVGGLVGFLCWWFICRGKA

SEQ ID NO: 531 - protein, 445 aa, Giardia intestinalis; identical to SEQ ID NO: 470

SEQ ID NO: 532 - protein, 642 aa, Giardia intestinalis
RAGCYEAAQQPGQTMCQAADAGVCTQAAQGYFVPPGADASHQSVIPCGDEEEITVKNDKKYKGVLHCTRCNAPTEAADANAKAATCTACQADRYLKTAKDQATSCVTEQECTGTEGFFAKNGGTKTCEACAETCKTCKTEAAKCTSCKDDKPYLKKDNGSDTGTCVTEAECKTGNTHYPDDTELKTCKTCAEGTSDGCATCEKGADGAVACKTCGNQKKVQPNKKGCVENCPSNSNDKKTPGTCECVEGYVPEEAGTGCTKKPDPPAAPCNTPGCKTCSEPKTSKEVCTECEDPKALTPTGQCIYGCEHLEGYYEGTSEGGKKACKKCEVENCLLCNGNGQCETCKDGYYKKETACAKCDTSCKTCANGEPNGCTSCEAKKALSYEGEGNTGTCKSECKPGTNNCEKCELTVDGTAYCSKCKDANQFPQNGVCSAAAGKAITCTTKGTGVCDKCANGLLRMNGGCYETTKFPGKSVCEEAASAGDTCQVEAPGYHLNNNDLVTCSAGCKTCTSNTVCTECMDGYAKTDNKRTKCATGCATCAGSASNCDTCSTGYYKYKNACVSCTESNSDKTITGVANCAYCAPPLNNKGSVLCYLVQSGENTNKSGLSAGAIAGIAVAVIIVVGGLVGFLCWWFMWRGKA

SEQ ID NO: 533 - protein, 150 aa, Giardia intestinalis
PKCDTSCKTCANGEPNGCTSCEAKKALSYEGESNTGTCKSECKPGTNNCEKCELTVDGTAYCSKCKDANQFPQNGVCSAAAGKAITCTTKGTGVCDKCANGLLRMNGGCYETTKFPGKSVCEEAASAGDTCQVEAPGYHLNNNDLVTCSA

SEQ ID NO: 534 - protein, 667 aa, Giardia intestinalis
MFGSFVLAGVLVQIAWAGKATERAAQCADNTNCAEEACNVLIGGKLYCSRCNTGFVPINGQCADKEGATDQCKDGSGGDTADQTCGQCAEQTFMYKGGCYEAAQQPGQTMCQAADAGVCTQAAQGYFVPPGADASHQSVIPCGDEEGITVKNDKKYKGVLHCTRCYAPTEAADANAKAATCTACGDSKIVKTAKDSATSCVTEEECTGTKTCKTCAEGTSDGCATCEKGADGAVACKTCGSNKKVQPNKKGCIAKCPETVSAEKDGVCECVEGYVPDNAGTGCTKKPDPQCNTPGCKTCSEPKTSKEVCTECEDPKALTPTGQCIYGCEHLEGYYEGTSEGGKKACKKCEVENCLLCNGQGQCETCKDGYYKSGAACAKCNTSCKTCANGNSNGCTSCEPKQVLSYEGEGTGTCKPGCKPVSGGKDGTCKSCDLNIDGTSYCSACNVGTEYPENGVCVKKSARTASCQAEPSNGVCGTCARGFFRMNGGCYETTKLPGKSVCEEVASAGDTCQTPADGYKLNNGALITCSAGCKTCTSQDQCDTCKAGYAKTGGNTKKCVPCATGCSECNADDATKCTVCAAGYYLSKEKCIACDKSDGGSITGVANCANCAPPTNNKGPVLCYLIQNTNRSGLSTGAIAGISVAVIAVVGGLVGFLCWWFICRGKA

SEQ ID NO: 535 - protein, 174 aa, Giardia intestinalis
DNTRAAACTTKDGKGGCSVCASGYFLLDGGCYQTSRQPGSQVCTTADSNGQCSQCANTLSPNDGVCPACPAGCSKCSGSSTCTECLAGYYLDSANACKKCSETSGDIQGVENCISCLAPTSPSTPTPVTCYVTQTPTVDPADPSVNKTGLSSGAIAGISVAVIAVVGGLVGFLC

SEQ ID NO: 536 - protein, 163 aa, Giardia intestinalis
SDGKCTACTGNYALLSGGCYNTKALPGKAVCTAASGGSCTTCANGQAYTNNNCPACAEGCSACTNGNTQQCTKCLAGYYLSNSKCFKCTADSNEGSNAITGVPNCVSCAPPTTSGTVTCYATQTPTVDPTDPSVNKGGLSTGAIAGISVAVIAVVGGLVGFLC

SEQ ID NO: 537 - protein, 157 aa, Giardia intestinalis
CTGKYFLESGGCYQAEKFPGNTLCTTTDSNGKCTGCANGQTADSGTGSCPACPTNCASCTGTSSKTCTKCFSGYYLDSANACKKCSETSGTITGVENCISCEKPSNGNGAVTCYVKTSGGGSSDNSTGGGPNLSSGAIAGISVAVIVVVGGLVGFLC

SEQ ID NO: 538 - protein, 161 aa, Giardia intestinalis
SGGVCTACTGDYALLSGGCYNTQALPGMAVCTAITGNNGQCTACANGQQPASGVCPACAEGCAKCQSSTSTCTACLAGYYLSGTKCVKCDKDDSNIKGVPNCVSCAAPASNTGTVTCYVTQTPTVDPTDPSVNKGGLSSGAIAGISVAVIAVVGGLVGFLC

SEQ ID NO: 539 - protein, 158 aa, Giardia intestinalis
ETAQTGGTCSTPAEGYKLDGSNNLVICPSNCKVCANKDSCSECARGYVKLSNAQTCTECAAGCATCAGTAATCDICTDGYYKSGSKCIACSKSEASIIGVSDRASCAPPASGTGSVLCYFMNSDVIDPDNKSSLSTGVIAGISVAAVAIVGGLAGFLC

SEQ ID NO: 540 - protein, 166 aa, Giardia intestinalis
SGGVCTVCTGANYALLSGGCYNTKVLPGMAVCTAITGNNGQCTACANGQQPASGVCPACAANCASCTGTDTKTCTKCLSGYYLDSGSVCRKCSEISGDILGVENCISCAPPTGNRGFVTCYVKTSGGSGGGDSTGGNNGSNFSTGMIVSISLTAVAVVGGLIGFLC

SEQ ID NO: 541 - protein, 130 aa, Giardia intestinalis
ANNGQCQTCANGQQPASGVCPACPANCASCTGTDTKTCTKCLSGYYLDSGSVCRKCSEISGDILGVENCISCAPPTGNRGFVTCYVKTSGGSGGGDSTGGNNGSNFSTGMIVSISLTAVAVVGGLIGFLC

SEQ ID NO: 542 - protein, 165 aa, Giardia intestinalis
SGGVCTVCTGANYALLSGGCYNTKVLPGMAVCTQAGSNGECKTCANGQTYANNNCPACAEGCSACNAGQTQQCTKCLAGYYLPNSKCFKCTADSNEGSNAITGVPNCVSCAPPTTSGTVTCYATQSPSVNPTDPSVNKTGLSSGAIVGISIAVIAVVGGLVGFLC

SEQ ID NO: 543 - protein, 120 aa, Giardia intestinalis
ITASNNGQCQTCANGQNPTNGNCPACAEGCAKCQRSTSTCTECLAGYYKTFASKCVKCSETSGNIQGVKNCISCEKPSSGNGAVTCYVKTDKGPNLSIGAIAGISVAVIVVVGGLVGFLC

SEQ ID NO: 544 - protein, 171 aa, Giardia intestinalis
STARANECKTPANKGGCSVCASGYFLLDNGCYKTDRQPGSQVCKTEGSGKCTKCANEQTPDQQGSCPACPAGCSKCSDANTCTECLAGYYLSGTKCVKCDKDDNAITGVPNCVSCAPPTTPPGPVTCYVTQEPSVNPTDPSVNKGGLSSGAIAGISVAVIAVVGGLVGFLC

SEQ ID NO: 545 - protein, 169 aa, Giardia intestinalis
DCEANTHFSTETPESGKKCFACGDTTNGVIGCEKCTAPGDGKTNPTCTKCTDKYLKTAADGTTTCVAKGACKDDYFTVDDSTNGHKCVSCGDETGVTDANSAQWKGVANCAKCTQPSAAGTVKCSECASGYKLEGEACVPASTNLSSGAIAGISVAVIAVVGGLVGFLC

SEQ ID NO: 546 - protein, 128 aa, Giardia intestinalis
ANNGQCQTCANGQTYASGNCPTCAEGCAKCQSSTSTCTECLAGYYLSNSKCVKCSENSADGNIKGVPNCVSCKEPSGGPGPVTCYVTQTPIVDPTDPSVNKGGLSSGAIAGISVAVIAVIGGLVGFLC

SEQ ID NO: 547 - protein, 127 aa, Giardia intestinalis
ANNGQCQTCANGQTYASGNCPTCAEGCAKCQSSTSTCTECLAGYCLSNSKCVKCSENSADGNIKGVPNCVSCVAPTTSGPVTCYVTQEPSVNPTDPSTNKGGLPSGAIAGISVAVIVVVGGLVGFLC

SEQ ID NO: 548 - protein, 173 aa, Giardia intestinalis
STARANECKTPDNKGGCSMCASGYFLLDNGCYKTDRQPGSQVCKTEGSGKCTKCANEQTPDQQGSCPACPAGCSKCSDANTCTECLAGYYLSGTTCVKCDKNSTDNKITGVENCVSCNPPSSNQGSVTCYVTQEPSVNPTDPSTNKTGLSSGAIAGISVAVIAVVGGLVGFLC

SEQ ID NO: 549 - protein, 128 aa, Giardia intestinalis
ANNGQCQTCANGQTYASGNCPTCAEGCAKCQSSTSTCTECLAGYYLSNSKCVKCSENSADGNIKGVPNCVSCAPPTGNSGPVTCYVTQEPSVNPTDPSTNKTGLSSGAIAGISVAVIAVVGGLVGFLC

SEQ ID NO: 550 - protein, 132 aa, Giardia intestinalis
PGDGKTNPTCTKCTDKYLKTAADGTTTCVAKGACKDDYFTVDDSTNGHKCVSCGDETGVTDANSAQWKGVANCAKCTQPSAAGTVKCSECASGYKLEGEACVPASTNLSSGAIAGISVAVIAVVGGLVGFLC

SEQ ID NO: 551 - protein, 127 aa, Giardia intestinalis
AANNGQCQTCANGQNATSGNCPACAEGCAECVSSISTCTECLAGYYLSGTKCVKCDKDDNAITGVPNCVSCAPPTTPPGPVTCYVTQTPTVDPADPSVNKGGLPSGAIAGISVAVIAVVGGLVGFLC

SEQ ID NO: 552 - protein, 129 aa, Giardia intestinalis
VTGNNGQCTTCANGQNANSGVCPVCPAGCSKCSGSNTCTECLAGYYLSGTTCVKCDKNSTDNKITGVENCVSCNPPSSNQGSVTCYVTQEPSVNPTDPSTNKTGLSSGAIAGISVAVIVVVGGLVEFLC

SEQ ID NO: 553 - protein, 165 aa, Giardia intestinalis
SGGVCTVCTGANYALLSGGCYNTKVLPGMAVCTQAGSNGECKTCANGQTYANNNCPACAEGCSACNAGQTQQCTKCLAGYYLSNSKCFKCTADSNEGSNAITGVPNCVSCAPPTTSGTVTCYATQSPSVNPTDPSVNKTGLSSGAIVGISIAVIAVVGGLVGFLC

SEQ ID NO: 554 - protein, 126 aa, Giardia intestinalis
ANSGSCTTCANGQTYASGNCPACAEGCAKCQSSTSTCTECLAGYYLSSSKCVKCTENSNGITGVPNCVSCAAPTSNSGPVTCYVTQTPTVDPADPSVNKTGLSSGAIAGISVAVIAVVGGLVGFLC

SEQ ID NO: 555 - protein, 137 aa, Giardia intestinalis
PAQGKTKPACTKCTSSNYLKTVDGTTTCVEKTACKDDFFPVDDSTNGHKCVSCGDETGVTDASNAKWNGVANCTKCTQPSAAGTAKCEECASGYILDSQANTCASASTNKSALSTGAIAGISVAAVVVVGGLAGFLC

SEQ ID NO: 556 - protein, 157 aa, Giardia intestinalis
CAGKYFLESGGCYQAEKFPGNTLCTTTDSNGKCTGCANGQTADSGTGSCPACPTNCASCTGTSSKTCTKCFSGYYLDSANACKKCSETSGTITGVENCISCEKPSNGNGAVTCYVKTSGGGSSDNSTGGGPNLSSGAIAGISVAVIVVVGGLVGFLC

SEQ ID NO: 557 - protein, 170 aa, Giardia intestinalis
VGGAGRAASACTPGDGVCTACTGNYYLLSGGCYQTTKLPGSSVCTEVKAGQNGQCQTCANGQSANGQGVCPSCPDNCATCSTTSTCSACFSGYYLTADTCTKCTENNGEVTGVTSCLSCAAPSSGKGSVICYVKTGSNSTGSGTNLSSGAIAGISVAVIVVVGGLVGFLC

SEQ ID NO: 558 - protein, 158 aa, Giardia intestinalis
ACTGKYFLESGGCYQAEKFPGNTLCTTTDSNGKCTGCANGQTADSGTGSCPACPTNCASCTGTSSKTCTKCFSGYYLDSANACKKCSETSGTITGVENCISCEKPSNGNGAVTCYVKTSGGGSSDNSTGGGPNLSSGAIAGISVAVIVVVGGLVGFLC

SEQ ID NO: 559 - protein, 126 aa, Giardia intestinalis
ATSGSCTTCANGQTYTSGTCPACAEGCAKCQSSTSTCTECLAGYYLSSSKCVKCTENSNGITGVPNCVSCAAPTSNSGPVTCYVTQTPTVDPADPSVNKSGLSSGAIAGISVAVIAVVGGLVGFLC

SEQ ID NO: 560 - protein, 163 aa, Giardia intestinalis
SDGKCTACTGNYALLSSGCYNTKALPGSAVCTTATSGSCTTCANGQQYTNNNCPACAEGCSACSNGNTQQCTKCFAGYYLSNSKCLKCTADSNEGSNAITGVPNCVSCAPPTTSGTVTCYVTQTPAVDPTDPSVNKTGLSSGAIAGIPVVVIAVVGGLVGFLC

SEQ ID NO: 561 - protein, 157 aa, Giardia intestinalis
CTEKYFLESGGCYQAEKFPGNTLCTTADAGKCTTCANGQDKDSNGSCPACPTNCASCAKDNTKTCNKCFSGYYLDTAKACKKCSETSGNIQGVENCISCAPPTGNRGFVTCYVKTSGGSGGGDSTGGNNGSNFSTGMIVSISLTAVAVVGGLIGFLC

SEQ ID NO: 562 - protein, 127 aa, Giardia intestinalis
VTGGNGQCSACANGQTYASGNCPACAEGCAKCATDTNQCDTCYSGHYKSGTKCVKCSENSNSITGVPNCVSCAPPSGSGTVTCYVTQEPSVNPTDPSVNKTGLSSGAIAGISIAVIVVVGGLVGFLC

SEQ ID NO: 563 - protein, 126 aa, Giardia intestinalis
ANSGSCTTCANGQTYASGNCPACAEGCAKCQSSTSTCTECLAGYYLSSSKCVKCTENSNGITGVPNCVSCAAPTSNSGPVTCYVTQTPTVDPADPSVNKSGLSSGAIAGISVAVIAVVGGLVGFLC

SEQ ID NO: 564 - protein, 259 aa, Giardia intestinalis
ACSPECAECVGPANNQCSSCPAGKKLTYTDDSNPNNGGTCGDACKVSADGTGCETCGAQIGGTAYCSKCKTSTQAPLNGDCAASSRATFCTKMGNGVCLQCEDNYFLKDGGCYQTDRQPGKQVCSNAQGGNGKCQTCANGLAATDGNCAECHPTCATCSVPSTASSCKTCATGYYKENGDDTTDGPCMKCSEKISGCKQCVSSSGSSVICLESEVGTGGSTNKSGLSTGAIAGISVAVIVVVGGLVGFLCWWFLCRGKA

SEQ ID NO: 565 - protein, 435 aa, Giardia intestinalis
ADTQVGKCKENMCEMAGSTEICTECKDQGNVPIDGICKPQNDNAVTTAGCKKKAGDNVDASSVRCEQCDAANHFLYKGGCYSKDATPGNQMCKTVTTNGICAEAATTKNYFVVPGATKTDQSVVWCGDVEGVTLGDGKNYTGVDGCTTCEKPEQATDAPKAATCNACGGGKIVKTVDGVTSCVEEADCNNGYFVDSRNGKKCSKCASSCKTCENTETQCTSCTEATPYLKKEDDSETGTCVNQGDCPATHYIDEAAKTCTTCTSGGAKDCKTCEKNGDGAVCKECPDSDKTIFGLNKKSCVASCPANSTPKATGQDSQVCECNEGLQPNTESTECRPISNCNTEHCLECTGEGADKEVCTKCLSEYYLTPTSQCVSDCTTLKGYYGDDSGKKTCKKCNDACVECKGEGADKCTACPAGKMLQYTDADTPANGARA

SEQ ID NO: 566 - protein, 342 aa, Giardia intestinalis
GTAKAYVGVDGCSQCTAPTALTTAGMTVAVCTACDSGKKPNKGGSGCVTCSVGDCKSCVVDNICGECVDGFYFKAGDAPSCVSAEACTNEEGFFIDATEKKCTACADDNCAVCVAKEQQKCSLCKTSGTKKYLKKDGESTTGTCVDTAGCPATHYVDEEAKECNTCVSAGTTDCTTCEKDANGVVCKTCTTDTKTIFGLNRKSCVASCPANSTPKATGQDSQVCECNEGLQPNTESTECQPISNCNTEHCLECTSEGADKEVCTKCLSEYYLTPTSQCVSDCTTLKGYYGNDTDRKCKKCNDACVECKGEGADKCTACPAGRMLQYTDADTPANGGRCMNQC

SEQ ID NO: 567 - protein, 495 aa, Giardia intestinalis
  misc_feature (46)..(46): Xaa can be any naturally occurring amino acid
AGSLKCTKCKPNRKPVGTSDNYTCTEKTCEDETACGGTSGACNAIXIDTDGNTKHYCSYCGDSSQAPIDGLCATDKKGNTACTSHTCPSCAANYFLYMNGCYSVSAQPGNYMCKKADNNGICTEAANNKYFIVPGASNQNQSVLACGNPLGTLVDTKAYVGVEGCSQCTAPVALTTVGMTVAVCTACDSGKKPNKGGSGCVTCSVGDCKSCVVDNICGECVDGFYFKAGDAPSCVSAEACTNEEGFFIDATEKKCTACADDNCAVCVAKEQQKCSLCKTSGTKKYLKKDGESTTGTCVDTAGCPATHYVDEEAKECNTCVSAGTTDCTTCEKGANGVVCKTCTTDTKTIFGLNRKSCVASCPANSTPKATGQDSQVCECNEGLQPNTESTECQPISNCNTEHCLECTSEGADKEVCTKCLCEYYLTPTSQCVSDCTTLKGYYGNDTDRKCKKCNDACVECKGEGADKCTACPAGRMLQYTDADTPANGGTCMNQC

SEQ ID NO: 568 - protein, 545 aa, Giardia intestinalis
  misc_feature (75)..(75): Xaa can be any naturally occurring amino acid
  misc_feature (129)..(129): Xaa can be any naturally occurring amino acid
  misc_feature (442)..(442): Xaa can be any naturally occurring amino acid
  misc_feature (451)..(451): Xaa can be any naturally occurring amino acid
ACVNSNESTGNTYADPESGTCRDCNTIDQACTQCEVDSTTKKPKCTACDSSKIPRTTLDGTSTCVAKNYAGCQGXDNGLFMTEDNVCRLCSDPAASDPEQKNKGIAGCKACMKTASANPTCTECLEGYXSTGVGSVTCTPCHAHCATCSAETAEDKCLTCKAGFFLVEVAKPAGKCISCSDTNNGGIDGCAECTKEASTFKCTGCKANYKQSGTSPVTCTKTCEDDTACGGTSGACDAMIIDDQGTTKHYCSYCGETNKIPIDGKCVDSGQKNGNTCDNHICTSCTTGYFLYMGGCYSVSTQPGKSMCKTAANGVCTAVNENNKYFLVPGASNAQQSVLACSNPLGTLVDPQGTAKAYVGVHGCSQCTAPAALTTVGMAAAVCTACDSGKKPNKGGSGCVTCSVGDCKSCVVDNICGECVDGFYFKAGDAPSCVSAEACTNXEGFFIDATXKKCTACADDNCAVCVAKEQQKCSLCKTSGTKKYLKKDGESTTGTCVDTAGCPATHYVDEEAKECNTCVSAGTTDCTTCEKGANGVVCKTCTTDT

SEQ ID NO: 569 - protein, 548 aa, Giardia intestinalis
FQLIPLFVVSALAVTCQADKCETVGNTEICTQCRARGVPVDGFCWPPGFPQAAAAGCTEEDGVPLDKTAATCGKCGDGYLLFMGGCYKTESQPGSDICTAASNGVCTECNTKNGLFKNPATAPEKGRECILCHDATGADGYMGVEGCATCTAPTNNKGAATCTECQDGYYNDGGACKKCVDGCIDCTGANQCTTCEDGKYLKNNQCVDAGQCDQGTYADPTTGQCKPCGITDCATCEYNATISQPQCKTCSTSSNKMVKTAADGTTTCVDDGGCTNGNTHFVEGTNQKLCVPCGDTTNGGVLGCNTCSSKTTCTKCLDGYYDSGSGTVTCTACPGANCATLCERYKRQCTTCKPGFFLKDSSSGECISCSDKNNGGHEGCSACSSNGAFKCTDCKPNYKKEGTSDNYTCVKTCEDETACGGTSGACDAIVIDENGNTKHYCSFCGESGKFPIDGLCASDKANNNGCANGVCTSCTAANYFLYMGGCYKVNTVPGSHMCKTANNGVCTAVSENNKYFIVPGASNQNQSVLACGNPLGTELTAKAYVGVK

SEQ ID NO: 570 - protein, 1154 aa, Giardia intestinalis
  misc_feature (686)..(686): Xaa can be any naturally occurring amino acid
MLVGFLLICATVLAKDSGKDTCFPGYTINTDTKQCTKDPEAPCNVEGCETCVEGNAQQCKTCRPGYTLNTDTKQCTKDPEAPCNVEGCETCVEGNAQQCKTCRPGYTLNTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVXGCETCVEGNAQQCKTCRPGYTINTDTKQCTKDPEAPCNVQGCETCVEGNAQQCKTCRPGYTINTDTKQCTKDPEAPCNVQGCETCVEGNAQQCKTCRPGYTINTDTKQCTKDPEAPCNVEGCETCVEGNAQQCKTCRPGYTINTDTKQCTKDPEAPCNTPNCKTCDNPKTDSEICTECNDGNYLTPTNQCVPDCTTISGYYGDTDKKCKACNPECAECVGPANNQCSSCPAGKKLTYTDDSNPNNGGTCGDACKVSADGTGCETCGAQIGGTAYCSKCKTSTQAPLNGDCAASSRATFCTKMGNGVCTQCEDNYFLKDGGCYQTDRQPGKQVCSSAQGGNGKCQTCANGLAATDGNCAECHPTCATCSTAGAADKCKTCATGYYKENGDDTTDGPCKKCSEKISGCKQCVSSSGSSVICLESEVGTGGSVNKSGLSTGAIAGIAVAVIVVVGGLVGFLCWWFLCRGKA

SEQ ID NO: 571 - protein, 394 aa, Giardia intestinalis
MLVGFLLVCATVLAKDSGKDTCFPGYTINTDTKQCTKDPEAPCNVEGCETCVEGNAQQCKTCRPGYTINTDTKQCTKDPEAPCNTPNCKTCDNPKTDSEICTECNDGNYLTPTNQCVPDCTTISGYYGDTDKKCKACNPECAECVGPANNQCSSCPAGKKLTYTDDSNPNNGGTCGDACKVSADGTGCETCGAQIGGTAYCSKCKTSTQAPLNGDCAASSRATFCTKMGNGVCTQCEDNYFLKDGGCYQTDRQPGKQVCSSAQGGNGKCQACANGLAATDGNCAECHPTCATCSTAGAADKCKTCATGYYKENGDDTTDGPCKKCSEKISGCKQCVSSSGSSVICLESEVGTGGSVNKSGLSTGAIAGIAVAVIVVVGGLVGFLCWWFLCRGKA

SEQ ID NO: 572 - protein, 739 aa, Giardia intestinalis; identical to SEQ ID NO: 475

SEQ ID NO: 573 - protein, 280 aa, Giardia intestinalis
  misc_feature (201)..(201): Xaa can be any naturally occurring amino acid
  misc_feature (277)..(277): Xaa can be any naturally occurring amino acid
NPQQCKTCGSGYTLNPTTKKCDRNSAPCEVEGCDVCEESNPQQCKTCGSGYTLNPTTKKCDRNSAPCDTPNCKACDNPKTDNEICTECNDNNYLTPTSQCVSDCTTLKGYYGDDSGKKTCKRCNDACAECKGEGADKCTACPAGKMLQYTDADTPANGGTCMNQCSVSPANDGCAECGAQIGGTAYCSKCKNTLQAPKDGXCAANTRTRFCTTVSNGACTQCENNYFLKDGGCYQTNRQPGKQVCTQANGGKCQTCANGLAATDGNCAECHPTCATXSTA

SEQ ID NO: 574 - protein, 1274 aa, Giardia intestinalis
MLVGFLLVCATVLAKDSGKDTCFPGYTLNTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTLNTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNVEGCETCVEGNAQQCKTCRPGYTINTDTKQCTKDPEAPCNTPNCKTCDNPKTDNEICTKCNDGDYLTPTNQCVPDCTAISGYYGDTDKKCKACNPECAECVGPANNQCTACPVGKMLQYTDTNTPVNGGTCMDQCSVSSTNDGCAECGAQIGGTAYCSKCKNTQQAPLNGNCAASSRVAFCATITSGACTKCNEGYFLKDGGCYQTDRQPGKQVCSNAQGGNGKCQTCANGLAASDGNCAECHSTCATCSTADAADKCKTCATGYNKENGDDTTAGLCKKCSEKISGCKQCVSSSGSSVICLESEVGTGGSVNKSGLSTGAIAGISVAVIVIVGGLVGFLCWWFLCRGKA

SEQ ID NO: 575 - protein, 556 aa, Giardia intestinalis
  misc_feature (121)..(121): Xaa can be any naturally occurring amino acid
  misc_feature (124)..(124): Xaa can be any naturally occurring amino acid
  misc_feature (126)..(126): Xaa can be any naturally occurring amino acid
  misc_feature (128)..(129): Xaa can be any naturally occurring amino acid
CTACGDSKIVKTAKDQATSCVTEKECTDAPGFFVDTTSGKKCSKCAETCKTCKTEAAKCTSCKDDKPYLKKDDESTTGTCVDANGCPATHYVDKEAKECNTCVSGGTVDCTTCETSANGVXCKXCXIXXKTKFALGKNSCVENCPSNSSDEKTLGTCECVEGYVPDDAGTGCTKKSDPQCNTPGCKTCSDPKKDKEVCTECEDPKALTPTGQCIDNCGDLGGYYEGTNEGGKKACKKCEVENCFLCNGQGQCETCKDGYYKSGAACAKCDTSCKTCANGKPNGCTSCEPKQVLSYEGEGTGTYKPECKPVSGGKDGTCKSCDLSIDGTSYCSACNVGTEYPENGVCVKKSARTASCQVEPSNGVCGTCAKGFFRMNGGCYETTKLPGKNVCEEAAPTGDTCQTPADGYKLNNGALITCSAGCKTCTSQDQCDTCKAGYAKTGGNTKKCVPCATGCSECNADDATKCTVCAAGYYLSKEKCIACDKSDGGSITGVANCANCAPPTNNKGPVLCYLIQNTNRSGLSTGAIAGISVAVIAVVGGLVGFLCWWFICRGKA

SEQ ID NO: 576 - protein, 435 aa, Giardia intestinalis
SSGCVDENHFKADDDSACYLCGDISGNNENTNKGVADCNKCTKEAGTKTTCSECLSGRFLETNTCTKKCADTCAKCTAETDINKCTECMPGYFLKTEGVTKECVPCSDTAKGGIDGCSVCSNDGNTSKCTDCKPNYRKQSDSSPGSVTCTKTCEDPTACGGTSGACDAMIIDDKGNAKHYCSYCGETNKFPIDGICNSDAQSNTCNNHVCTSCTTGYFLYMGGCYSVSAQPGNYMCKTADSSGICTEAANNRYFLVPGASNTDQSVLACSNPLGTLTGTGDTAKAYVGVDGCSACTAPTQLEAPGMAPATCTACSGNNKPNLAGSGCFACTVSGCSHCGAGDKCEGCTSKDQKPSLDGSQCIACSIDGCVRCSEENKCGQCSDGYRLEGGRCVSSGANRSGLSAGAIAGISVAVVAVVGGLVGFLCWWFVCRGKA

SEQ ID NO: 577 - protein, 435 aa, Giardia intestinalis
SSGCVDENHFKADDDSACYLCGDISGNNENTNKGVADCNKCTKEAGTKTTCSECLSGRFLETNTCTKKCADTCAKCTAETDINKCTECMPGYFLKTEGVTKECVPCSDTAKGGIDGCSVCSNDGNTSKCTDCKPNYRKQSDSSPGSVTCTKTCEDPTACGGTSGACDAMIIDDKGNAKHYCSYCGETNKFPIDGICNSDAQSNTCNNHVCTSCTTGYFLYMGGCYSVSAQPGNYMCKTADSSGICTEAANNRYFLVPGASNTDQSVLACSNPLGTLTGTGDTAKAYVGVYGCSACTAPTQLEAPGMAPATCTACIGNNKPNLAGSGCFACTVSGCSHCGAGDKCEGCTSKDQRPSLDGSQCIACSIDGCVRCSEENKCGQCSDGYRLEGGRCVSSGANRSGLSAGAIAGISVAVVAVVGGLVGFLCWWFVCRGKA

SEQ ID NO: 578 - protein, 401 aa, Giardia intestinalis
SSNCVDADHFKADGDSACVLCSDTSGSDPKNKGIAGCKACTKTASANPTCSECLAGYYSSGSGTVTCTACGQNCATCTQAGNNQCTKCKAGFFLKGNGPGECVPCDDAQNQGIEGCAECTGTTGSLKCTKCKPNRKPAGNQDNYTCTEKTCEDETACGGTAGSCDATVIDNQGNAKHYCSYCGEANKFPINGVCVESSQKNGNNCNSHTCTSCAQGYFMYMGGCYDASKAPGNHMCKTADNGVCTTPNANNRYFLVPGASNTDQSVLACSNPLGTLVGTGDTAKAYVGVLNCSQCTAPAALSDGGMAAAICTSCDSSKVPNRDGSGCVLCSDTNCKSCVMDGVCGECSDGYSLEGGRCVSSGANRSGLSTGAIAGISVAVIAVVGGLIGFLCWWFVCRGKA

SEQ ID NO: 579 - protein, 560 aa, Giardia intestinalis
MFLLINCLIASTLAGACSTTQANCVAEKCEMVGETEICTQCKQNYVPINGVCEAAASSNTKCKAANGSDNADQTCKKCLLQTFMFKGGCYDKAGETGNLICTDAASGTTGVCATCKEADGFFRNPDAADTTDSCILCNDTTGVTIGESNNAKTYTGITNCVKCTKPDQLSAPGTKAATCTECASNLYLKTDSSATPATSCVTAETCKTGYFPNDNADSKKKCLACNTAANGGIDKCAECSLLTPASRAGAILITCTKCSTNSLSPLKDACLTSCPAGTYETGSPNKVCTPCHTSCAGCKDDNTAASCTACYPGSVLSYGSDNTKGTCIAECTGKYLENCADGQCTASIAGSKYCSKCKSGFVPVNGLCVSAETARAAPPGCTPDKTNGVCTACTEKYFLESGGCYQAEKFPGNTLCTTADAGKCTTCANGQDKDSNGSCPACPTNCASCAKDNTKTCNKCFSGYYLDTAKACKKCSETSGNIQGVENCISCLAPTSPQSSTPVTCYVKTSGGGSGDNSTGGDSGPNLSSGAIAGISVAVIVVVGGLVGFLCWWFVCRGKA

SEQ ID NO: 580 - protein, 503 aa, Giardia intestinalis
  misc_feature (310)..(310): Xaa can be any naturally occurring amino acid
MLLIAFYLILSTFAIACKNSGNSCEVGQCDTIGDTEICMQCNQGKVPINGICTAIQPDAAPNCKKAGGGELDQNAQVCGQCTGAYFLYKGGCYNSAQGVGAKLCTQAEQGVCKAPAAGYFIPPDAIAKDQSIMSCGDTTELVLVSNKKKYKGVAFCSACTPPPSAENTATAAVAACSACQSGYNLVQGENVCKRSDGCTIPGCKTCSSDKKTCEVCEDQKISAPSKEACLEGCPAGSYESNKKCAPCHVSCSSCSDGNSNSCTACYPGFVLNREADDNKGTCVPECTGKYMENCAEGQCDGVVGGSKYCXKCITNFAPVDGICVPTNSAMKKATGCTAGDGVCNSCTGEYFLQTNGCYRSAMFPGNIVCNNAQDGKCKKCANEQQPEGNTGSCPACPENCEKCNGVDNQKVCTNCLPGYYLDGNKACKRCSENSNYIIGNSNCVSCAVQSTGSGSMLCYVMKSDNGTNNKSGLSIGAIAGISVAVVVVVGGLVGFLCWWFLCR

SEQ ID NO: 581 - protein, 719 aa, Giardia intestinalis
MFGRFLLAIVILQLARAACEEDKTSTDGKCKTCGVTIGQDTWCSVCIGENYAPINGTCADITTDSVGSVFCTQKAGGVCTQCAGNSFMFAGGCYSSSEGLPGYNLCLRSAGNGVCAEAAPGYFIPGETAATKPSVISCSDKTGLLITAHTYKGVEFCEECSGSELTSGQDGTAKCTKCGASKYLKDNACVDNAEACGKGYFGKPDAAAGNKCIACTDQSGGGATGCAECMYDSNTRKAICTKCTTDYLRKKADGTTECVAVNECDDTQKGFYKVVDSTNGNKCVSCADGAGLAVGADGAWKGVDGCAKCTKPADINTPTKCDECKPGYEISTDKTKCTSTAPPDCPIENCKVCSEDKRACEECNSNNYLTPTRMCIDDCKKIGNYYYTTNANNKLICKECAVANCKECENTGTCKTCDDGFYKSSEECKACDSNCKTCNGGTSADCTKCLSGAVLKYGNDGTKGTCGAGCATGTGAGACKTCGLIIDGTSYCSECAVETEYPQGGVCSSTTVRAAATCKAGSVAKGMCNSCTNGFLRMNGGCYETTKFPGKSVCEEAASAGDTCQKEAPGYHLNNNDLVTCSPGCKTCTSNTVCTACMEGYVKTSDSCAKCAAGCATCTGSTTACDTCSTGYYESGTTCVSCTESNSDKTITGVANCASCAPPLNNKGSVLCYLIKDSGSTNKSGLSTGAIAGIAVAVVIVVGGLVGFLCWWFICRGKA

SEQ ID NO: 582 - protein, 719 aa, Giardia intestinalis
  misc_feature (659)..(659): Xaa can be any naturally occurring amino acid
MFGRFLLAGAILQLARAACEEDKTSTDGKCKTCGVTIGQDTWCSVCIGENYAPINGTCADITTDSVGSVFCTQKAGGVCTQCAGNSFMFAGGCYSSSEGLPGYNLCLRSAGNGVCAEAAPGYFIPGETAATKPSVISCSDKTGLLITAHTYKGVEFCEECSGSELTSGQDGTAKCTKCGASKYLKDNACVDNAEACGKGYFGKPDAAAGNKCIACTDQSDGGTAGCAECMYDSNTRKAICTKCTTDYLRKKADGTTECVAANECDDTQKGFYKVVDSTNGNKCVSCADGAGLAVGTDGAWKGVDGCAKCIKPADINTPTKCDECKPGYEISTDKTKCTSTAPPDCPIENCKVCSEDKRACEECNSNNYLTPTRMCIDDCKKIGNYYYTSNANNKLICKECAVANCKECENTGTCKTCDDGFYKSSEECKACDSNCKTCNGGTSADCTKCLSGAVLKYGNDGTKGTCGAGCATGTGAGACKTCGLIIDGTSYCSECAVETEYPQGGVCSSTTVRAAATCKAGSVAKGMCNSCTNGFLRMNGGCYETTKFPGKSVCEEAASAGDTCQKEAPGYHLNNNDLVTCSPGCKTCTSNTVCTACMEGYVKTSDSCAKCAAGCATCTGSTTACDTCSTGYYKSGTTCVSCTESNSDKTITGVANCAXCAPPLNNKGSVLCYLIKDSGSTNKSGLSAGAIAGISVAVIIVVGGLVGFLCWWFMCRGKA

SEQ ID NO: 583 - protein, 704 aa, Giardia intestinalis
MFGRFLLAIVILQLARAACQADGSGSDGSCKTCGVTIGQEQYCSECNGANYAPVNGQCADVNAEGQSKTLCPAKGQGKCTQCGGASFMYKDGCYSKDTAPGQSMCTQASEGKCTEAAPGYFLNPLRANTKDSVVSCSDTTGFTDSGKTYRGVQHCERCDGAALTDAAGGDAKCTRCGQDKYLATTGTCGEGCTPDTEFSKEDSDNGKRCFACGDVTTGVASCEKCTPPSPDQAKPACTKCGGNNYLKTAADGTTTCVEQSACSPDSFPVENSQSGNRCVLCGDAANGGVDKCAACTPTDQGRIAPTITCIACTNGYKPSADKTTCEAVSNCKTPGCKACSNEGKENEVCTDCDSSTYLTPTSQCIDSCAKIGNYYGATEGAKKICKECTAANCKTCDGQGQCQACSDGFYKNGDACSPCHESCKTCSAGTASDCTECPTGKALRYGDDGTKGTCGEGCTTGQGSGACKTCGLTIDGASYCSECATTTEYPQNGVCAPKASRATPTCNDSPIQNGVCGTCADNYFKMNGGCYETVKYPGKTVCISAPNGGTCQKAADGYKLDSGTLTVCSEGCKECTSSTDCTTCLDGYVKSASACTKCDSSCETCNGAATTCKACATGYYKTASGEGACTSCESDSNGVTGIKGCLNCAPPSSSTGSVLCYLIQNTNKSGLSAGAIAGISVAVIVVVAGLVGFLCWWFICRGKA

SEQ ID NO: 584 - protein, 235 aa, Giardia intestinalis
IDGASYCSECDTQNEHPQNGVCAATNRRTMTCNNLGSGVCNTCANGLLRMNGGCYETTKFPGKSVCEGANADADTCKTPTPGYKVEAGKLVTCSKGCDTCSDATICTKCGDGYTKIGSSQTCTKCDASCETCNGAATTCKACATGYYKTTSGEGACTSCENDSNGVTGVKGCLNCAPPSSSTGSVLCYLMKDGDSTGGSTNKSGLSTGAIAGISVAVIVVVGGLVGFLCWWFICR

SEQ ID NO: 585 - protein, 234 aa, Giardia intestinalis
  misc_feature (233)..(233): Xaa can be any naturally occurring amino acid
IDGASYCSECATATEYPQNGVCAPKASRATPTCNDSPIQNGVCGTCANSYFKMNGGCYETVKYPGKTVCISAPNGGTCQKAADGYKLDSGTLTVCSEGCKECTSSTDCTTCLDGYVKSASACTKCDFSCETCNGAATTCKACATGYYKTASGEGACTSCESDSNGVTGIKGCLNCAPPSSNTGSVLCYLMKDGDSTGGSTNRSGLSTGAIAGISVAVIVVVGGLVGFLCWWFXC

SEQ ID NO: 586 - protein, 709 aa, Giardia intestinalis
  misc_feature (708)..(708): Xaa can be any naturally occurring amino acid
MFGRFLLAIVILQLARAACQADGSGSAGSCKTCGVAIGQEQYCSECNGANYAPVNGQCADVNAEGPSKTLCPAKDQGKCTQCGGNSFMLAGGCYSSGEGLPGHSLCLSSGGDGVCTEAAPGYFLNPLRANTKDSVVSCSDTAGFTDSGKTYRGVQYCERCDGAVLTDAAGGDAKCTRCGENKYLATTGTCGEGCTPDTEFSKEDSDNGKRCFACGDVTTGVASCEKCTPPSPDQAKPACTKCGGNNYLKTAADGTTTCAEQSACSPDSFPVENSQSGNRCVLCGDAANGGVDKCAACTPADKGRAAPAVTCTACTDGYKPSADKTTCEAVSSCKTPGCKACSNEGKENEVCTDCDGSTYLTPTSQCIDSCAKVGNYYGAIEGAKKLCKECTAANCKTCDGQGRCQTCSDGFYKNGDACSPCHESCKTCSAGTASDCTECPTGKALRYGDDGTKGTCGAGCATGQGSGACKTCGLTIDGASYCSECATATEYPQNGVCAPKASRATPTCNDSPIQNGVCGTCANSYFKMNGGCYETVKYPGKTVCISAPNGGTCQKAADGYKLDSGTLTVCSEGCKECTSSTDCTTCLDGYVKSASACTKCDFSCETCNGAATTCKACATGYYKTASGEGACTSCESDSNGVTGIKGCLNCAPPSSNTGSVLCYLMKDGDSTGGSTNRSGLSTGAIAGISVAVIVVVGGLVGFLCWWFXC

SEQ ID NO: 587 - protein, 667 aa, Giardia intestinalis
MLLAIFYFVISALTAKCTPQTQTCEAEKCETIGETEICTQCQAGNVPIDGKCVEANTVSEKCKNASGDADANQVCGKCIGANFFMYKGGCYDKQGTPGSTICKTAGEGVCDDCQEGYFKNPEAAATTDSCISCGDMIGVTIIKDTNAKTYKGVDGCAKCTPPNRITGNAGIKTATCTGCDSNKIVKTDTSGTSCIEESACSNGFFVSDQRKAQSKDYKCIPRIDDPAKANCTACSDNKKPNLEGTECNSCTDQHCAFCVAEGTCQKCSSGFILDGQNCVKSDCKTENCKACTNPKAANEVCTECVFTHHLTPTSQCVQYCQTLGNYYAGTNADNKNACKECRVANCKTCVDQGQCQTCNNGFYKNGDACSPCHESCKTCSAGTASDCTKCPTGKALRYGNDGTKGTCGEGCTTGKGSGACKTCGLTIDGASYCSECATTTEYPQNGICTSTTARTAATCKNSNVANGICSLCTNGFLRMNGGCYETTKFPGKSVCTTTPDADTCTSVTSGYYIDGSSNLVVCSDGCAECTTSSACTTCKDGYTKIGNSQTCTKCDSSCETCTGAAITCKACATGYYKTALGESTCTSCETDSNGVTGIKGCLNCAPPSSNTGSVLCYLMKDADSTGGNTNKSGLSTGAIAGISVAVIVVVAGLVGFLCWWFICRGKA

SEQ ID NO: 588 - protein, 234 aa, Giardia intestinalis
  misc_feature (74)..(74): Xaa can be any naturally occurring amino acid
IDGASYCSECATTTEYPQNGVCTSATARAAATCKTGNVAKGACSSCTNGLLRMNGGCYETTKFPGKSVCLAAAXASDTCQTPADGYKLNNGALITCSAGCKTCTSQDQCDTCKAGYAKDSGNTKKCVPCATGCSECNADDATKCTVCAAGYYLSKEKCIACDKSDGGSITGVANCASCAPPSNNQGSVLCYLIKDSGSTNKSGLSAGAIAGISVAVIVVVGGLVGFLCWWFICR

SEQ ID NO: 589 - protein, 4 aa, Artificial sequence
  Motif
  misc_feature (2)..(3): Xaa can be any naturally occurring amino acid
CXXC

SEQ ID NO: 590 - protein, 4 aa, Artificial sequence
  Motif
GGCY

SEQ ID NO: 591 - protein, 5 aa, Artificial Sequence
  Motif
CRGKA

What is claimed is:

1. A therapeutic composition comprising a VSP (Variant-specific Surface Protein) carrier and a bioactive peptide, wherein
   (i) the VSP carrier can bind to the bioactive peptide;
   (ii) the VSP carrier is not covalently bound to the bioactive peptide via a peptidic bond;
   (iii) the bioactive peptide is therapeutically effective after binding to the VSP carrier;
   (iv) the binding of the VSP carrier to the bioactive peptide increases the resistance of the bioactive peptide to pH-mediated and/or enzymatic degradation compared to the resistance of the same bioactive peptide not bound to said VSP carrier;
   (v) the bioactive peptide is selected from the group consisting of insulin, human growth hormone, and glucagon;
   (vi) the bioactive peptide is not a vaccine immunogen, and
   (vii) the VSP carrier has at least 70% amino acid sequence identity with the sequence of the extracellular domain of a VSP from *Giardia* selected from VSP1267 (SEQ ID NO: 490), VSP9B10 (SEQ ID NO: 572), and VSPH7 (SEQ ID NO:504).

2. The composition of claim 1, formulated for oral administration.

3. The composition of claim 1, formulated for mucosal administration.

4. The composition of claim 1, wherein the VSP carrier further comprise a protein purification tag sequence.

5. The composition of claim 4, wherein the protein purification tag sequence is a His6 tag.

6. The composition of claim 1, wherein the VSP carrier consists of the sequence of SEQ ID NO:1.

7. The composition of claim 1, wherein the insulin is a natural insulin.

8. The composition of claim 1, wherein the insulin is a recombinant insulin.

9. The composition of claim 1, wherein the insulin is an insulin analog.

10. The composition of claim 9, wherein the insulin analog is a fast-acting insulin.

11. The composition of claim 9, wherein the insulin analog is a long-acting insulin.

12. The composition of claim 10, wherein the fast-acting insulin is insulin aspart.

13. The composition of claim 11, wherein the long-acting insulin is insulin glargine.

14. The composition of claim 1, wherein the molecule to molecule ratio of VSP carrier to the bioactive peptide ranges from about 10:1 to about 1:10.

15. The composition of claim 14, wherein the molecule to molecule ratio of VSP carrier to the bioactive peptide ranges from about 3:1 to about 1:3.

16. The composition of claim 15, wherein the molecule to molecule ratio of VSP carrier to the bioactive peptide is 3:1.

17. The composition of claim 15, wherein the molecule to molecule ratio of VSP carrier to the bioactive peptide is 1:1.

18. The composition of claim 1, further comprising a pharmaceutically acceptable excipient.

19. A method of delivering a bioactive peptide to a target location in a subject comprising administering the therapeutic composition of claim 1 to a subject in need thereof.

20. A method of treating a disease or condition in a subject comprising administering an effective amount of the therapeutic composition of claim 1 to a subject in need thereof, wherein the disease or condition is a hormone deficiency.

21. The method of claim 20, wherein the hormone deficiency is an insulin deficiency.

22. The method of claim 21, wherein the insulin deficiency is type 1 diabetes.

23. A method of treating a disease or condition in a subject comprising (a) combining a VSP carrier and a bioactive peptide, wherein the VSP carrier can bind to the bioactive peptide, wherein the bioactive peptide is not a vaccine immunogen, therein the VSP carrier is not covalently bound to the bioactive peptide via peptidic bonds, wherein the bioactive peptide is therapeutically effective after binding to the VSP carrier, the binding of the VSP carrier to the bioactive peptide increases the resistance of the bioactive peptide to pH-mediated and/or enzymatic degradation compared to the resistance of the same bioactive peptide not bound to said VSP carrier, wherein the bioactive peptide is selected from the group consisting of insulin, human growth hormone, and glucagon, and wherein the VSP carrier has at least 70% amino acid sequence identity with the sequence of the extracellular domain of a VSP from *Giardia* selected from VSP1267 (SEQ ID NO:490), VSP9B10 (SEQ ID NO:572), and VSPH7 (SEQ ID NO:504); and wherein administering an effective amount of the combination of said VSP carrier and bioactive peptide treats the disease or condition in the subject, wherein the disease or condition is a hormone deficiency.

24. A method of making an orally deliverable composition, comprising combining a VSP carrier and a bioactive peptide, wherein the VSP carrier can bind to the bioactive peptide, wherein the bioactive peptide is not a vaccine immunogen, therein the VSP carrier is not covalently bound to the bioactive peptide via peptidic bonds, the binding of the VSP carrier to the bioactive peptide increases the resistance of the bioactive peptide to pH-mediated and/or enzymatic degradation compared to the resistance of the same bioactive peptide not bound to said VSP carrier, wherein the bioactive peptide is therapeutically effective after binding to the VSP carrier, wherein the bioactive peptide is selected from the group consisting of insulin, human growth hormone, and glucagon, and the VSP carrier has at least 70% amino acid sequence identity with the sequence of the extracellular domain of a VSP from *Giardia* selected from VSP1267 (SEQ ID NO:490), VSP9B10 (SEQ ID NO:572), and VSPH7 (SEQ ID NO:504).

25. A method of making an injectable composition suitable for oral administration comprising combining a VSP carrier and a bioactive peptide, wherein the VSP carrier can bind to the bioactive peptide, wherein the bioactive peptide is not a vaccine immunogen, wherein the VSP carrier is not covalently bound to the bioactive peptide via peptidic bonds, the binding of the VSP carrier to the bioactive peptide increases the resistance of the bioactive peptide to pH-mediated and/or enzymatic degradation compared to the resistance of the same bioactive peptide not bound to said VSP carrier, thereby making the injectable composition suitable for oral administration, wherein the bioactive peptide is therapeutically effective after binding to the VSP carrier, wherein the bioactive peptide is selected from the group consisting of insulin, human growth hormone, and glucagon, and the VSP carrier has at least 70% amino acid sequence identity with the sequence of the extracellular domain of a VSP from *Giardia* selected from VSP1267 (SEQ ID NO:490), VSP9B10 (SEQ ID NO: 572), and VSPH7 (SEQ ID NO: 504).

26. (Withdrawn-previously presented) The method of claim 25, wherein the VSP carrier further comprises a protein purification tag sequence.

27. The method of claim 26, wherein the protein purification tag sequence is a His6 tag.

28. The method of claim 25, wherein the VSP carrier consists of the sequence of SEQ ID NO:1.

29. The method of claim 28, wherein the insulin is a natural insulin.

30. The method of claim 28, wherein the insulin is a recombinant insulin.

31. The method of claim 28, wherein the insulin is an insulin analog.

32. The method of claim 31, wherein the insulin analog is a fast-acting insulin.

33. The method of claims 31, wherein the insulin analog is a long-acting insulin.

34. The method of claim 32, wherein the fast-acting insulin is insulin aspart.

35. The method of claim 33, wherein the long-acting insulin is insulin glargine.

36. The composition of claim 1, wherein the VSP carrier having at least 70% amino acid sequence identity with the sequence of the extracellular domain of VSP1267 (SEQ ID NO: 490), VSP9B10 (SEQ ID NO:572), or VSPH7 (SEQ ID NO: 504) is selected from SEQ ID NO: 58, 143, 163, 166, 167, 308, and 486, or a fragment thereof.

* * * * *